(12) United States Patent
Ogden et al.

(10) Patent No.: US 11,976,384 B2
(45) Date of Patent: May 7, 2024

(54) METHODS AND COMPOSITIONS FOR PROTEIN DETECTION

(71) Applicant: Manifold Biotechnologies, Inc., Allston, MA (US)

(72) Inventors: Pierce Ogden, Jamaica Plain, MA (US); Gleb Kuznetsov, Boston, MA (US); Shane Lofgren, Boston, MA (US); Kathleen Nudel, Jamaica Plain, MA (US); Hoong Chuin Lim, Newton Center, MA (US); Karen Duffy, Somerville, MA (US); Jeffrey Chang, Somerville, MA (US)

(73) Assignee: Manifold Biotechnologies, Inc., Boston, MA (US)

( * ) Notice: Subject to any disclaimer, the term of this patent is extended or adjusted under 35 U.S.C. 154(b) by 0 days.

(21) Appl. No.: 17/518,221

(22) Filed: Nov. 3, 2021

(65) Prior Publication Data

US 2023/0134536 A1   May 4, 2023

(51) Int. Cl.
| | | |
|---|---|---|
| *C40B 40/08* | (2006.01) | |
| *C07K 16/00* | (2006.01) | |
| *C07K 16/18* | (2006.01) | |
| *C07K 17/02* | (2006.01) | |
| *C12N 15/10* | (2006.01) | |

(52) U.S. Cl.
CPC ............ *C40B 40/08* (2013.01); *C07K 16/005* (2013.01); *C07K 16/18* (2013.01); *C07K 17/02* (2013.01); *C12N 15/1037* (2013.01); *C07K 2317/55* (2013.01)

(58) Field of Classification Search
None
See application file for complete search history.

(56) References Cited

U.S. PATENT DOCUMENTS

2017/0260534 A1* 9/2017 Koseki .................. C12N 15/09

FOREIGN PATENT DOCUMENTS

| WO | WO-2008/156789 A2 | 12/2008 |
|---|---|---|
| WO | WO-2013/143026 A1 | 10/2013 |
| WO | WO-2015/095355 A2 | 6/2015 |
| WO | WO-2017/190138 A1 | 11/2017 |
| WO | WO-2020/097254 A1 | 5/2020 |

OTHER PUBLICATIONS

Egloff, P. et al., Engineered Peptide Barcodes for In-Depth Analyses of Binding Protein Ensembles, Nat. Methods, 16(5):421-428 (2019).
Elshal, M. F. and McCoy, J. P., Multiplex Bead Array Assays: Performance Evaluation and Comparison of Sensitivity to ELISA, Methods, 38(4):317-323 (2006).

(Continued)

*Primary Examiner* — Christian C Boesen
(74) *Attorney, Agent, or Firm* — Choate, Hall & Stewart LLP; Brenda Herschbach Jarrell; Margo R. Monroe

(57) ABSTRACT

Methods and systems for quantification of an abundance of one or more payloads (e.g. proteins) in a mixture (e.g. a complex mixture (e.g. in vivo)) using barcodes (e.g. peptide barcodes), binders (e.g. polypeptide binders), and binding agents (e.g. phage) are provided herein.

15 Claims, 22 Drawing Sheets

Specification includes a Sequence Listing.

(56) References Cited

OTHER PUBLICATIONS

Engvall, E. and Perlmann, P., Enzyme-linked immunosorbent assay, Elisa: 3. Quantitation of specific antibodies by enzyme-labeled anti-immunoglobulin in antigen-coated tubes, Journal of Immunology, 109(1):129-135 (1972).

Holliger, P. et al., "Diabodies": Small Bivalent and Bispecific Antibody Fragments, Proc. Natl. Acad. Sci. U.S.A., 90:6444-6448 (1993).

Mohan, D. et al., PhIP-Seq Characterization of Serum Antibodies Using Oligonucleotide Encoded Peptidomes, Nat. Protoc., 13(9):1958-1978 (2018).

Poljak, R. J., Production and Structure of Diabodies, Structure, 2:1121-1123 (1994).

Pollock, S. B. et al., Highly multiplexed and quantitative cell-surface protein profiling using genetically barcoded antibodies, Proc. Natl. Acad. Sci. U.S.A., 115(11):2836-2841 (2018).

Shendure, J. et al., Accurate multiplex polony sequencing of an evolved bacterial genome, Science, 309(5741):1728-1732 (2005).

Towbin, H. et al., Electrophoretic transfer of proteins from polyacrylamide gels to nitrocellulose sheets: procedure and some applications, Proc. Natl. Sci. U.S.A., 76(9):4350-4354 (1979).

Trads, J. B. et al., Site-Selective Conjugation of Native Proteins with DNA, Acc. Chem. Res., 50(6):1367-1374 (2017).

Xu, G. J. et al., Comprehensive serological profiling of human populations using a synthetic human virome, Science, 348(6239):11 pages (2015).

Matsuzaki, Y. et al., Peptide barcoding for one-pot evaluation of sequence-function relationships of nanobodies, Sci Rep., 11(1):21516 (2021).

No Author Listed, Could protein barcodes speed up drug development?, Manifold Bio scores $5.4M to find out, Fierce Biotech, Retrieved from the Internet: https://www.fiercebiotech.com/biotech/could-protein-barcodes-speed-up-drug-development-manifold-bio-scores-5-4-million-to-find, retrieved on Feb. 8, 2023.

No Author Listed, Manifold Bio's molecular 'barcodes' could breakthrough pharma's in vivobottleneck, retrieved from the Internet: https://techcrunch.com/2022/07/14/manifold-bios-molecular-barcodes-could-break-through-pharmas-in-vivo-bottleneck/, retrieved on Feb. 8, 2023.

Wroblewska, A. et al., Protein Barcodes Enable High-Dimensional Single-Cell CRISPR Screens, Cell, 175(4):1141-1155 (2018).

International Search Report for PCT/US2022/079134, 8 pages, mailing date Apr. 19, 2023.

Written Opinion for PCT/US2022/079134, 8 pages, mailing date Apr. 19, 2023.

\* cited by examiner

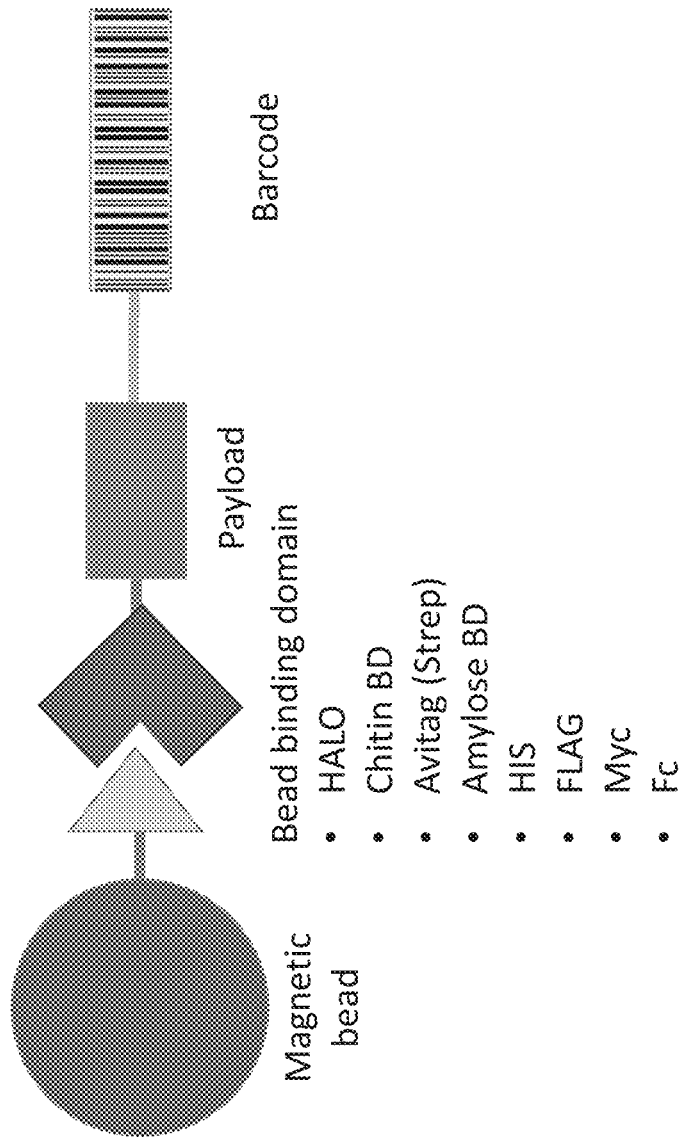

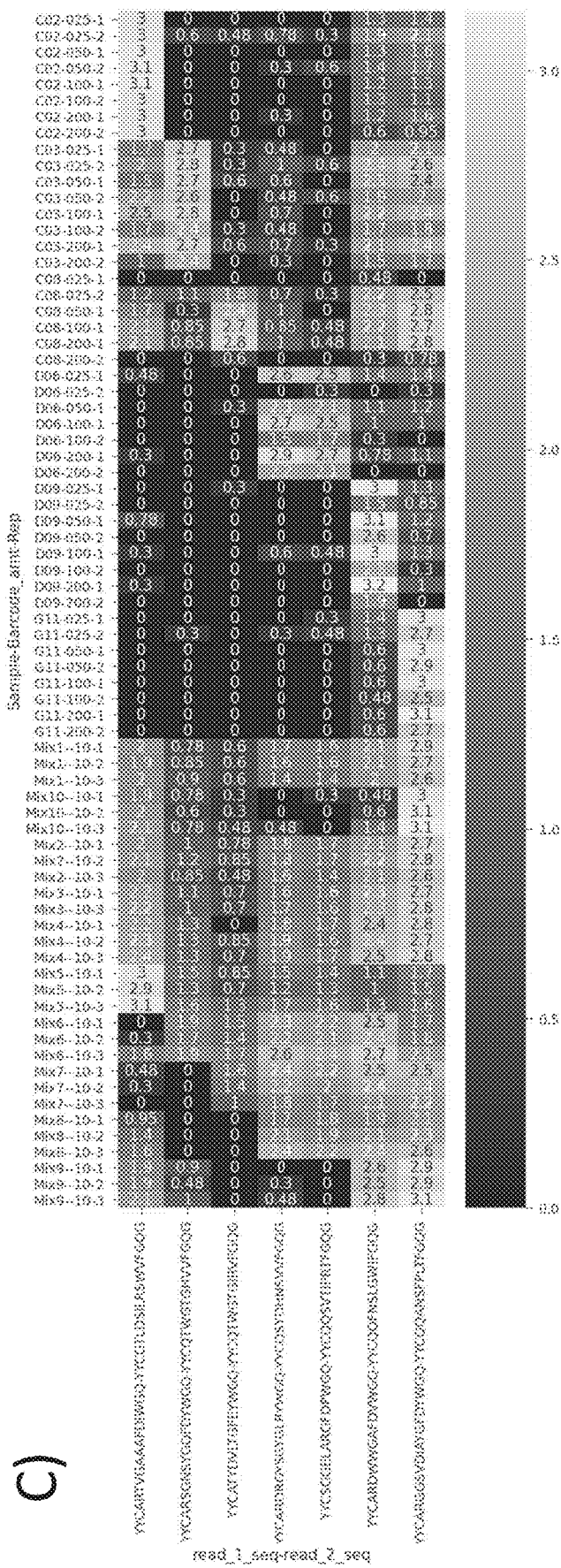
Fig. 6 (Contd.)

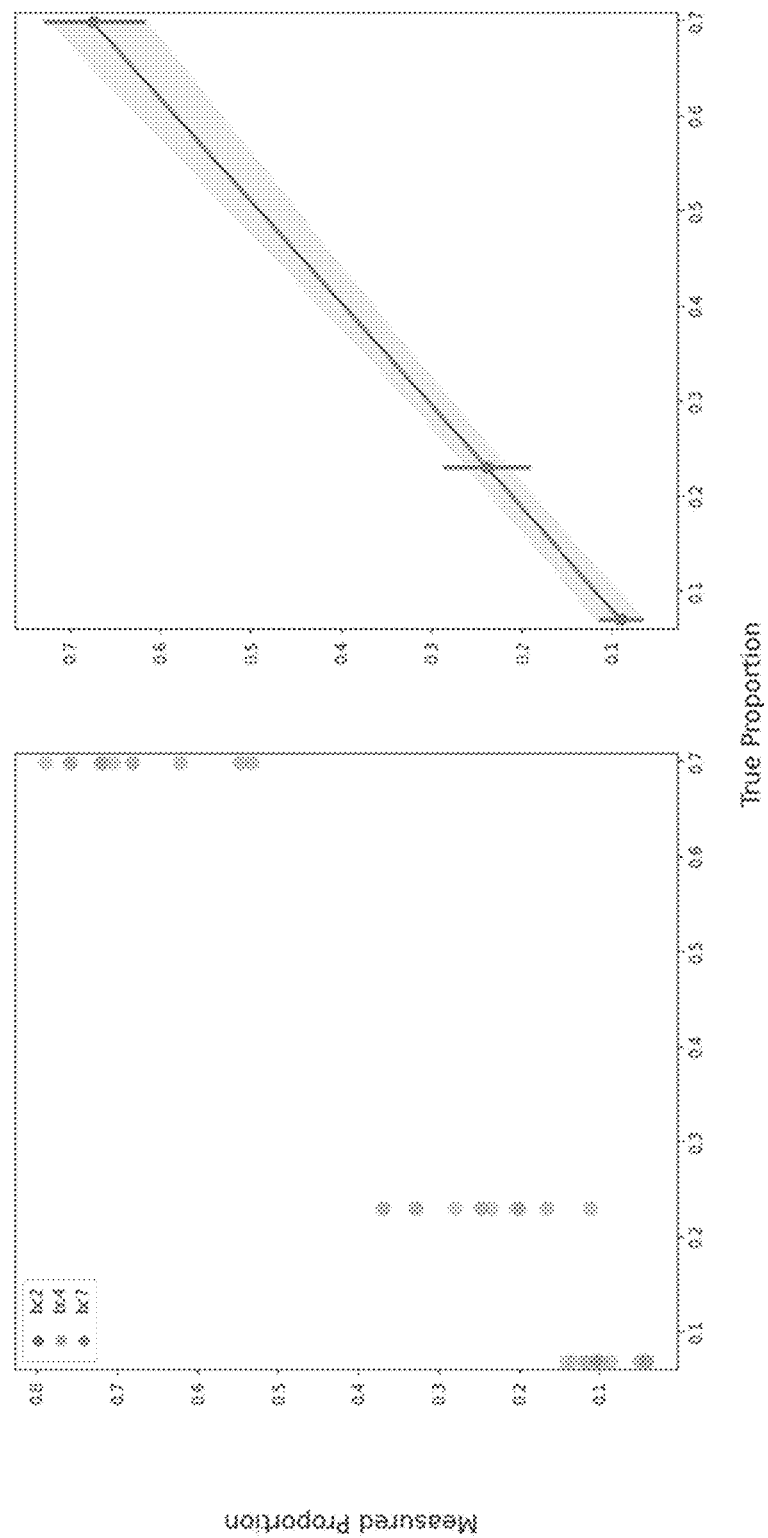
Fig. 8 (Contd.)

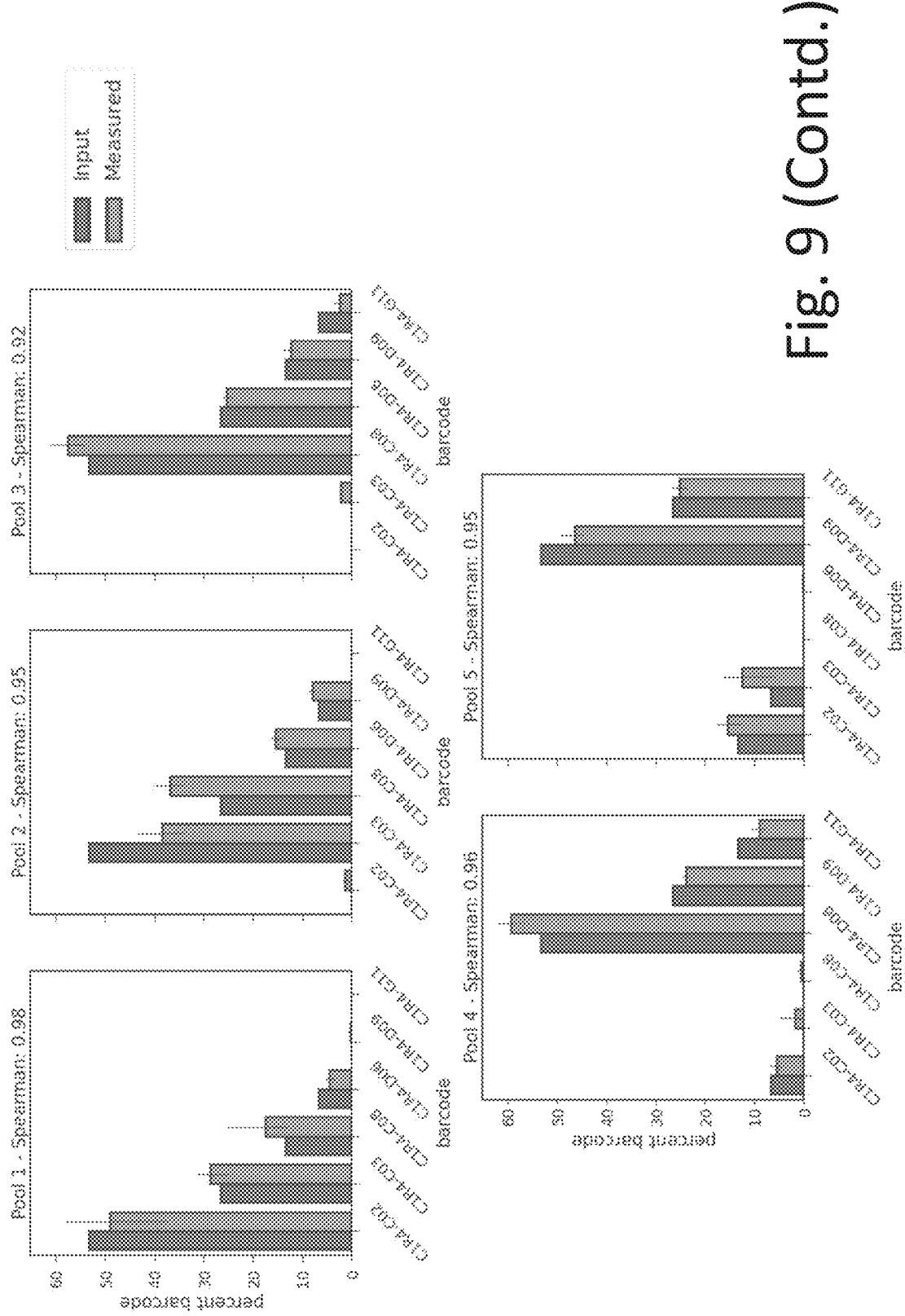
Fig. 9 (Contd.)

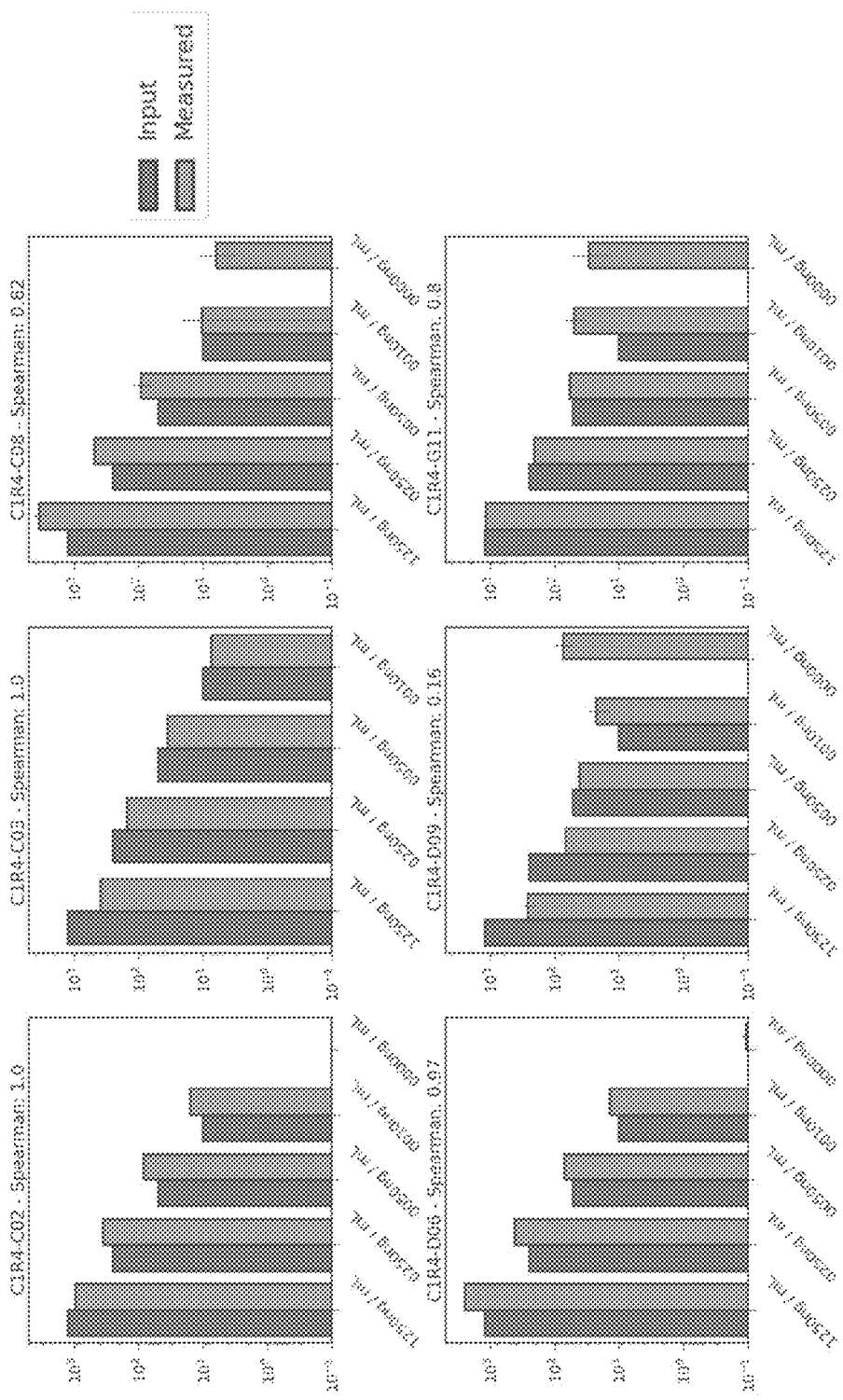
Fig. 10 (Contd.)

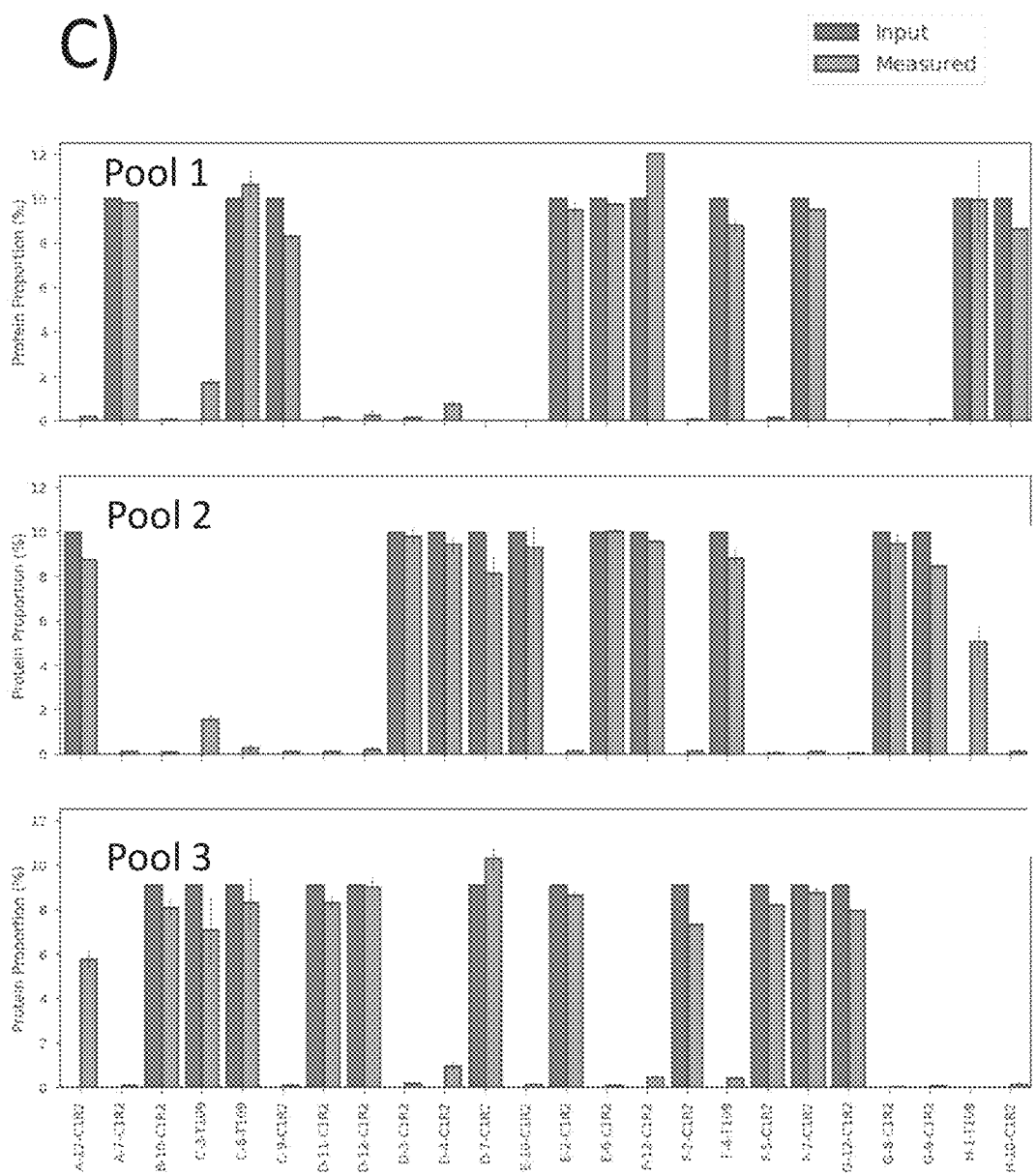
Fig. 12 (Contd.)

D)
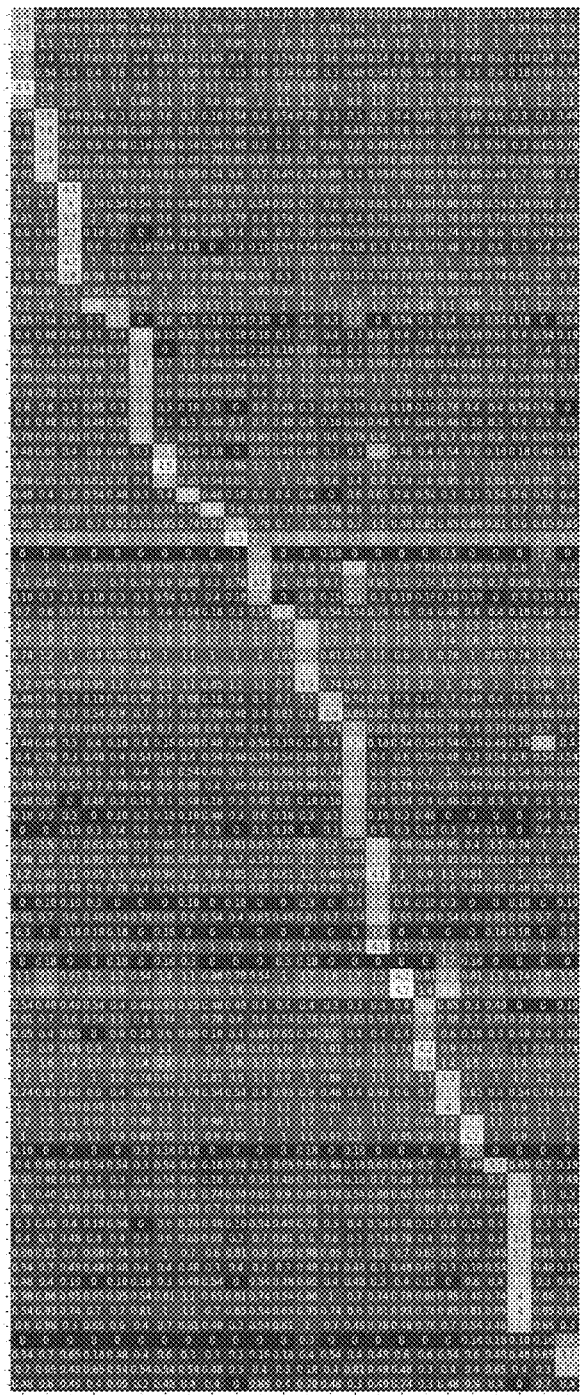
Fig. 12 (Contd.)

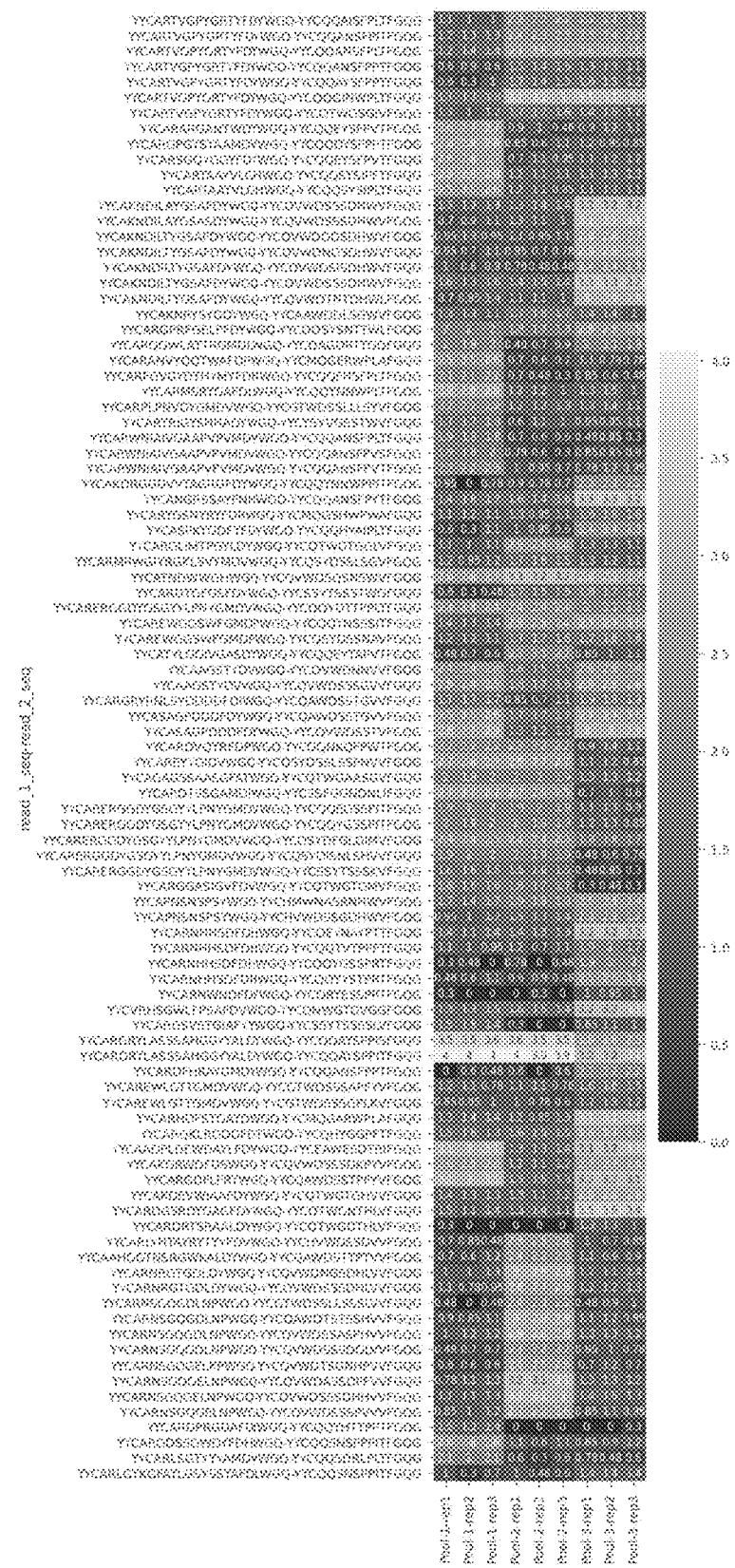
Fig. 12 (Contd.)

METHODS AND COMPOSITIONS FOR PROTEIN DETECTION

BACKGROUND

Assessments of binding agents (e.g., phages, polypeptide binders, antibodies, etc.) are central to much of molecular and pharmaceutical biology.

SEQUENCE LISTING

The present specification makes reference to a Sequence Listing (submitted electronically as a .txt file named 2013703-0002_Sequence_Listing.txt) on Jan. 19, 2022. The .txt file was generated on Dec. 14, 2021, and is 5,592,163 bytes in size. The entire contents of the Sequence Listing are herein incorporated by reference.

SUMMARY

The present disclosure provides insights and technologies that achieve improved or otherwise desirable assessment of agents (e.g., binding agents, therapeutic agents, and/or in some embodiments polypeptide agents such as antibody agents).

Among other things, the present disclosure appreciates that many current technologies for assessing, and in particular for determining presence and/or abundance of, one or more agents of interest, typically rely on mass spectroscopy and/or affinity (e.g., immuno-) detection. The present disclosure appreciates that many available affinity detection technologies are slow and/or costly to perform or implement; many such technologies must be performed one at a time and many are constrained, for example, by availability of fluorogenic substrates (e.g., that may be assessed by relevant technologies—e.g., light microscopy).

The present disclosure further appreciates that certain other technologies, such as DNA barcoding technologies, that are sometimes utilized to assess agents of interest, can also suffer disadvantages. DNA barcodes, for example, can lack stability and/or display undesirable immunogenicity, e.g., when utilized in vivo. The present disclosure appreciates that such technologies therefore can encounter problems, particularly for assessing agents (e.g., protein agents) in complex environments (e.g., in vivo).

Among other things, the present disclosure encompasses the recognition of the source of certain problems with available technologies typically utilized to assess agents of interest, and in particular to assess protein agents and/or binding agents (i.e., agents which participate in one or more binding interactions of interest). In particular, the present disclosure identifies the source of certain problems encountered by such technologies for assessment (e.g., detection and/or measurement of quantity, such as concentration) of multiple agents, and in particular when such agents are present in a complex system (e.g., in a complex solution and/or in vivo).

Furthermore, the present disclosure provides certain technologies that achieve such assessments, in some embodiments with surprisingly high accuracy. Those skilled in the art will appreciate that a number of contexts exist in which detection and/or measurement (e.g., of a precise amount), of a plurality of agents within a complex system is desirable; moreover, those skilled in the art will appreciate the benefit of high accuracy in many such contexts.

Among other things, the present disclosure provides technologies that achieve detection and/or measurement (e.g., highly accurate and/or otherwise precise measurement) of one or more, and in some embodiments of a plurality, of agents (e.g., protein agents), including in complex systems (e.g., in vivo). In some embodiments, detected agent(s) may be or comprise proteins (i.e., polypeptides) and/or forms thereof (e.g., aggregated; complexed; covalently modified such as by disulfide bond formation, glycosylation, pegylation, phosphorylation; truncated such as by proteolytic cleavage, etc.).

In some embodiments, provided technologies are particularly useful or effective for assessment of therapeutic agents. For example, in some embodiments, provided technologies may be particularly useful for the assessment of one or more features (e.g. properties (e.g., concentration, localization, persistence, affinity, etc.)) of agent(s) of interest; in some such embodiments, relevant agent(s) may be characterized by one or more attributes appropriate or desirable for therapeutic use. For example, in some embodiments, provided technologies may be used to screen potential therapeutic agents (e.g. polypeptide entities) for one or more features (e.g. properties, attributes) suitable for therapeutic use. In some embodiments, each feature of potential therapeutic agent(s) may be measured one at a time. In some embodiments, two or more features of potential therapeutic agent(s) may be measured simultaneously. For example, in some embodiments, one or more therapeutic agents may be screened for an affinity to a target protein—yet other desirable properties for example molecular stability in a physiologically relevant environment are not yet known. In some embodiments, for example, one or more therapeutic agents may be screened for an affinity to a target protein, along with other desirable properties, for example molecular stability in a physiologically relevant environment.

The present disclosure appreciates that many current methods of protein measurement rely on determining the abundance of light of a certain wavelength, or overall luminescence, such as western blot or ELISA (Towbin 1979, Engvall 1972). Due to constraints of visible light wavelength, these methods allow for only a small number of different proteins, often fewer than 4, to be measured at a single time within a single reaction (Elshal, 2006). The present disclosure appreciates that many applications, including drug discovery applications, would benefit from (and, in some cases, require) dramatically higher throughput.

The present disclosure further appreciates that nucleic acid sequencing technologies (e.g., DNA sequencing technologies) have been developed that can analyze billions of individual DNA molecules in a single experiment (Shendure, 2005). Various strategies have been developed to try to apply this massive throughput achievable with nucleic acid sequencing techniques to protein detection and measurement, in particular by tagging proteins with an attached piece of DNA (typically referred to as a "DNA barcode"), which may then be sequenced to indirectly detect the protein (Trads 2017) or one or more features of the protein.

The present disclosure appreciates the power of applying high-throughput nucleic acid sequencing technologies to assessment of other agents, and in particular of protein agents, but also identifies the source of certain problems associated with many approaches utilized to study proteins by attachment of DNA barcodes. For example, the present disclosure appreciates that modification of a protein by attachment of a DNA barcode can often alter its functionality (Trads 2017), which can defeat the purpose of using the DNA barcode to assess the protein.

Known techniques to quantify barcoded proteins include those as presented in Egloff et al. (2019), that use mass spectrometry to determine the presence or absence of a protein sequence in a mixture (Egloff 2019). The present disclosure identifies the source of a problem with such approaches, however, and moreover provides certain advantages relative to them, including, for example, by using nucleic acids (e.g. DNA) for amplification of the original signal; approaches such as those described in Egloff et al. fail to include (or to benefit from) such a feature. Furthermore, as may be appreciated by a person of ordinary skill in the art, reading the present disclosure, mass spectrometry only reads out the mass-to-charge ratio of an associated sequence; thus methods using mass spectrometry are limited in their total throughput, since different sequences can have the same mass-to-charge ratio. By comparison, the present invention is not limited by such disadvantages since the nucleic acid sequence associated with one or more binding agents in turn associated with each barcode is sequenced and measured to determine and quantify the barcoded protein.

Other techniques available in the art use antibodies displayed on phage (Fab-phage) to determine presence of endogenous proteins expressed on cell surfaces (Pollock 2018). In such methods, one Fab-phage is generated per endogenous protein (i.e. target protein to be assessed) and no barcodes are utilized. In contrast, the present technology envisions the use of engineered barcode sequences that are generalizable, such that they can be used to mark any protein, whether endogenous or exogenous to the context in which it is applied, and subsequently measured using one or more binding agents to which each barcode, and therefore each barcoded protein, is uniquely associated with (i.e. 'barcode fingerprint' as described elsewhere in this disclosure). Such complex association of one or more binding agents with a barcode is then measured and precise quantification of the associated protein is achieved, e.g., using a complex algorithm (i.e. 'decoding' as described elsewhere in this disclosure).

The present disclosure recognizes the ability of antigens displayed on phages to determine epitopes of antibodies within the blood to which the phages are able to bind (Mohan 2018). However, this method is not able to determine the sequence of the antibody to which the antigen binds, and thus only provides limited information on any antibodies that specifically bind to the antigens displayed on phage. However, the present disclosure provides systems, compositions, and methods that provide the advantage of using generic barcodes with known affinities to one or more binders or binding agents, that can be used to tag any target(s) of interest in a complex mixture, including but not limited to blood, to determine and quantify the target(s).

The present disclosure, among other things, provides technologies that can achieve assessment (e.g. detection and/or quantification) of multiple agents (e.g., multiple protein agents) within a pool of such agents, using DNA sequencing without requiring (direct or indirect) covalent association of the DNA with the assessed agent, or otherwise constraining the assessed agent.

Described herein are peptide barcodes (also known as "barcodes") and technologies to make and/or utilize them. In some embodiments, barcodes are utilized to mark payloads. Among other things, such an approach can achieve pooled measurement of protein payloads without amending non-protein identifiers. In some embodiments, a peptide barcode is an amino acid polypeptide sequence. In some embodiments, a peptide barcode is contained within a protein (e.g. a protein (e.g. an antibody) to be measured; i.e. is endogenous to a protein to be measured). In some embodiments, a peptide barcode is not contained with a protein (e.g. a protein (e.g. an antibody) to be measured; e.g. is exogenous to a protein to be measured). In some embodiments, a barcode, for example, is sequence (e.g. a designed sequence) contained within a protein (e.g. a protein to be measured). In some embodiments, a barcode is associated (e.g. bound (e.g. covalently)) to the N terminus of a protein (e.g. a protein to be measured). In some embodiments, a barcode is associated (e.g. bound (e.g. covalently)) to the C terminus of a protein (e.g. a protein to be measured). In some embodiments, a barcode is associated (e.g. bound (e.g. covalently)) proximal to the N terminus (e.g. internal to a protein (e.g. a loop region that is proximal to the N terminus)) of a protein (e.g. a protein to be measured). In some embodiments, a barcode is associated (e.g. bound (e.g. covalently)) proximal to the C terminus e.g. internal to a protein (e.g. a loop region that is proximal to the C terminus)) of a protein (e.g. a protein to be measured).

The methods disclosed herein may use peptide barcodes that are designed to have varying lengths. In some embodiments, a peptide barcode may have a length ranging between 1-100, 5-50, 8-25, 9-25, or 9-15 amino acids. In some embodiments, a peptide barcode may have a length of at least 25 amino acids. In some embodiments, a peptide barcode may have a length of at most 8 amino acids. In some embodiments, a peptide barcode may have a length of 10 amino acids.

Barcode sequences as described herein may be reused, so as to be able to quantify different payloads (e.g. proteins of interest) or mixture of payloads (mixture of proteins of interest to be measured). In some embodiments, a barcode is generated such that it can be easily reused between several different payload (e.g. proteins to be measured) molecules across different experiments.

Among other things, barcodes described herein are designed to be distinct/unique. In some embodiments, a barcode is designed to have a distinct sequence (e.g. distinct from another barcode). For example, each barcode is designed to be distinct (e.g. unique) from every other barcode used in an experiment, such that each payload (e.g. protein to be measured) is attached to at least one barcode, and each barcode (e.g. barcode with a specific sequence) is only attached to one payload. As may be understood by a person of ordinary skill in the art, the diversity of barcodes contained within a pool is limited only by the possible diversity of amino acid sequences for a given barcode length. For example, for a barcode length 'N', there exists $20^N$ distinct amino acid barcode sequences of length N.

Methods described herein relate to the detection of one or more barcodes using a binding agent. In some embodiments, a barcode is contacted with a binding agent that is associated with or comprises a detectable nucleic acid. For example, in some embodiments, a binding agent may be or comprises a phage, a ribosome. mRNA. DNA etc. In some embodiments, a binding agent is a phage with a binding motif on its surface (e.g. a polypeptide binder as described herein). In some embodiments, a binding agent comprises a detectable nucleic acid. In some embodiments, a binding agent expresses a detectable nucleic acid. In some embodiments, a binding agent expresses a detectable nucleic acid on (e.g. on a surface of) the binding agent (e.g. a binder). In some embodiments, a binder is polypeptide. In some embodiments, a binder associates with a barcode (e.g. with known specificity and affinity). In some embodiments a binder associates with one or more barcodes (e.g. with different known specificities and affinities). In some embodiments, a binder is an antibody (e.g. expressed on a surface of a binding agent). In some embodiments, for example, to detect the presence of a specific (e.g. distinct) barcode, the present disclosure envisions the association of a distinct detectable nucleic acid (e.g. a DNA sequence, an RNA sequence, etc.) to a specific barcode. This is achieved through the contact of a binder, which may be expressed on (e.g. on a surface of) a binding agent that comprises the distinct detectable nucleic acid.

Described herein are binders. In some embodiments, a binder, is a polypeptide. In some embodiments, for example, a binder is generated to have known specificity and affinity for a given barcode. In some embodiments, a binder is generated to have known specificity and affinity for one barcode. In some embodiments, a binder is generated to have known specificity and affinity for multiple (e.g. two or more, three or more, etc.) barcodes. In some embodiments, a binder is generated to have known specificity and affinity for at least one barcode. In some embodiments, a binder, for example, is expressed on the surface of a binding agent (e.g. a phage, a ribosome, etc.) using methods known to those skilled in the art.

Among other things, systems and methods described, for example, as described herein, identify the advantages of nucleic acid sequencing techniques and apply them effectively to protein detection and measurement methods. For example, methods described herein may use several binders, with known specificities and affinities to different barcodes, which can be expressed on binding agents and mixed together in a single pool. Upon mixing with a pool of barcoded proteins (i.e. proteins, each associated with a barcode as described herein), a binder expressed on a binding agent binds to any given barcode in the pool with known but varying affinities. Such a spectrum of affinities of a binder to various barcodes is termed herein as a 'Binder Fingerprint'. Conversely, a barcode may bind to any given binder in a pool of binders with known but varying affinities. Such a spectrum of affinities of a barcode to various binders is termed herein as a 'Barcode Fingerprint'. Thus, the presence of specific barcoded proteins can be detected, for example, in a complex solution, by extracting and sequencing the associated nucleic acid (e.g. detectable nucleic acid (e.g. DNA sequence, RNA sequence, etc.)) of the population of binding agents (e.g. phage) that bound to the barcodes associated with the proteins.

Other methods to use binders to identify protein sequences have been developed. However, these methods encounter a number of challenges, including difficulty in generating and characterizing binders, and effectively decoding their binding to specifically identify proteins. Another limitation with previously developed binders is their non-specific binding that results in bad signal to noise ratios, thereby negatively affecting the accuracy of detection. In contrast, the present technology generates many binders rapidly (e.g., in about a week, about 2 weeks, about 3 weeks, about 4 weeks, about 1 month, about 2 months, about 3 months, about 4 months, about 5 months, about 6 months, or about 1 year). In some embodiments, for example, between about 100 to about 1000 binders may be generated rapidly. In some embodiments, between about 10 to about 1000 binders may be generated rapidly. In some embodiments, between about 10 to about 10,000 binders may be generated rapidly. In some embodiments, at least about 10.000 binders may be generated rapidly.

Binders as described herein are robust. Binders can bind to barcodes (e.g. with robust affinities to one or more barcodes) as described herein in a variety of conditions and/or environments. For example, binders as described herein can bind to barcodes (e.g. with robust affinities to one or more barcodes) in various complex environments (e.g. in blood, tissue, serum, plasma, etc.). Thus, binders of the present disclosure may be used to detect targets (e.g. proteins of interest) in varying conditions (e.g. physiological conditions).

Analogously, barcodes, as described herein, may be generated in a rapid and robust manner. In some embodiments, barcodes as described herein are specific to binders as described herein. In some embodiments, for example, between about 100 to about 2000 barcodes may be generated rapidly (e.g. in about a week, about 2 weeks, about 3 weeks, about 4 weeks, about 1 month, about 2 months, about 3 months, about 4 months, about 5 months, about 6 months, or about 1 year). In some embodiments, between about 10 to about 1000 barcodes may be generated rapidly. In some embodiments, between about 10 to about 10,000 barcodes may be generated rapidly. In some embodiments, at least about 10,000 barcodes may be generated rapidly.

Barcodes as described herein are robust. Barcodes can bind to binders (e.g. with robust affinities to one or more binders) as described herein in a variety of conditions and/or environments. For example, barcodes as described herein can bind to binders (e.g. with robust affinities to one or more binders) in various complex environments (e.g. in blood, tissue, serum, plasma, etc.). Thus, barcodes of the present disclosure may be used to detect targets (e.g. proteins of interest) in varying conditions (e.g. physiological conditions). The present disclosure, therefore corrects for the disadvantages and defects of existing methods (e.g. non-specific binding, variable binding in different environments, etc.) by generating large numbers of robust binders and barcodes rapidly, which may be used in combination with computational methods (e.g. deconvolution methods) described herein, to allow for specific, well-characterized binder-barcode binding/association and accurate detection methods.

The present disclosure also envisions the ability to modify the sequence(s) of one or more peptide barcode sequences such that they are optimally distinguishable from each other, and/or from potential background protein sequence. Analogously, present disclosure also envisions the ability to modify the sequence(s) of one or more polypeptide binder sequences such that they are optimally distinguishable from each other, and/or from potential background protein sequence.

Among other things, the present invention as described herein provides methods of testing 'n' distinct protein candidates where n≥1, in a single assay or animal model. In some embodiments, a protein candidate is a therapeutic protein candidate. In some embodiments, multiple protein candidates are designed and each distinct protein candidate is associated with its own unique peptide barcode as described herein. Such barcoding has many advantages, including but not limiting to injecting all protein candidates in a single injection in to an assay and/or an animal in a cost and time efficient manner. Subsequently, a sample (e.g. tissue sample, serum sample, blood sample, extracellular sample, single cell sample etc.) from an injected animal may be obtained and barcodes extracted. In some embodiments, such extracted barcodes provide a measure of the relative abundance of protein candidates originally injected. For example, one or more extracted barcodes may be identified by contacting them with a pool of binders (e.g. expressed on a binding agent) known to bind to the barcodes originally bound to the protein candidates. Following binding of barcodes and binders, bound binding agents (e.g. phage) are selected and their detectable nucleic acid (e.g. DNA sequence, RNA sequence, etc.) extracted. In some embodiments, extracted nucleic acids are subjected to sequencing (e.g. next generation sequencing). The sequenced nucleic acid may then be used to identify the one or more barcodes they were designed to bind to, which along with the previously established information on binding affinities between various binder-barcode pairs may be used to identify and determine the relative abundance of each protein originally injected.

Also described herein, are methods used to translate nucleic acid counts, for example from a sequencing experiment, to relative or absolute protein quantifications. In some embodiments, nucleic acid sequences are counted and in silico translated into protein sequences. As is described herein, a nucleic acid sequence corresponds to a binder sequence, with established and characterized affinity for every barcode given in a pool. In some embodiments, binder counts are compared to a database of known propensities for binding to a single barcode. In some embodiments, binder counts are compared to a database of known propensities for binding to multiple barcodes (e.g. two or more, three or more, etc.). In some embodiments, for example in a sequencing experiment, relative proportions of binder counts are compared directly in order to determine relative proportions of barcodes and/or proteins associated with barcodes. In some embodiments, as may be known to a person of ordinary skill in the art, sequences (e.g. control sequences or accessory sequences) of known abundance (e.g. count, quantification, concentration, etc.) are utilized (e.g. added in to the sequencing experiment) to determine an absolute abundance (e.g. count, quantification, concentration, etc.) for a given binder or binders, which may be used to estimate an absolute abundance (e.g. count, quantification, concentration, etc.) for a barcode or barcodes, and/or protein(s) associated with barcode(s) using either direct counts or a linear model as described herein.

In some embodiments, payloads is or comprise proteins. In some embodiments, payloads is or comprise therapeutic proteins. In some embodiments, payloads are associated (e.g. linked with) barcodes as described herein.

Among other things, the present disclosure provides a method of assessing barcodes, binders (e.g. binding agents (e.g. with binders expressed on a surface)), payloads, (e.g. barcoded payload (e.g. barcoded proteins)) as described herein. In some embodiments, a method comprises subjecting a population of barcoded payloads (e.g. barcoded proteins) to an assessment; separating those members of a population that satisfy an assessment from those that do not, so that either a positive population or a negative population, or both is identified; contacting a positive population, or a negative population, or each population separately from the other, with a set of binders which includes at least one particular binder specific for each barcode in a population; and determining which binders bind to separated members, thereby determining which barcoded payloads (e.g. barcoded proteins) are present in a contacted population(s).

The present disclosure provides a method comprising contacting a set of binders either with a first population, with a second population, or separately with each of a first and second populations, of barcoded payloads (e.g. barcoded proteins); and determining which binders of a set bind to a member of a first population, a second population, or both, thereby determining which barcoded payloads (e.g. barcoded proteins) are present in contacted population(s). In some embodiments, each binder binds specifically (e.g. with known affinities) to one or more barcodes. In some embodiments, a set of binders, collectively, includes at least one binder specific for each of the barcodes in first and second populations. In some embodiments, a first and second populations have been separated from one another based on performance in an assessment.

In some embodiments, a method further comprises determining differences between a first and second population, to determine a functional effect of a performance assessment. In some embodiments, a method comprises separating binders that bind to at least one payload (e.g. barcoded payload (e.g. barcoded protein)).

In some embodiments, a step of determining comprises quantifying a number of binders that bind to a barcoded payload (e.g. barcoded protein). In some embodiments, quantifying may be performed by decoding a nucleotide sequence of each binder that binds to a barcoded payload (e.g. barcoded protein). In some embodiments, quantifying a number of binders that bind to a payload (e.g. barcoded protein) provides measure of a payload (e.g. protein) in a population.

In some embodiments, a step of determining comprises amplifying nucleic acids of bound phage particles. In some embodiments, a step of determining comprises determining nucleotide sequences of amplified nucleic acids. In some embodiments, one or more of determined nucleotide sequences corresponds to a coding sequence of a binder. In some embodiments, a step of determining comprises detecting one or more payloads (e.g. proteins) from a population of barcoded payloads (e.g. barcoded proteins) using determined sequence(s) of a coding sequence of a binder. In some embodiments, a step of determining comprises identifying one or more barcoded payloads (e.g. barcoded proteins) as a therapeutic or a target to treat a disease, disorder, or condition.

In some embodiments, a step of determining comprises performing one or more of amplification, propagation, and sequencing (e.g. nucleic acid (e.g. DNA, RNA) amplification, propagation, and/or sequencing). In some embodiments, amplification may be performed using one or more of Polymerase Chain Reaction (PCR), Loop-mediated Isothermal Amplification (LAMP), Rolling Circle Amplification (RCA), or a similar known technique. In some embodiments, sequencing may be performed using one or more of Illumina, Next Generation Sequencing (NGS), nanopore sequencing, Pac Bio long read sequencing, or a similar known technique.

In some embodiments, a step of separating comprises purifying one or more barcoded payloads (e.g. barcoded proteins) from a sample. In some embodiments, barcoded payloads (e.g. barcoded proteins) are purified from a complex sample. In some embodiments, barcoded payloads (e.g. barcoded proteins) are purified from a complex mixture. In some embodiments, barcoded payloads (e.g. barcoded proteins) are purified using affinity purification methods (e.g. FLAG IP, protein G/A) or protein precipitation methods.

In some embodiments, a method further comprises injecting a population of barcoded payloads into an animal. In some embodiments, a method further comprises injecting a population of barcoded payloads (e.g. barcoded proteins) into an animal. In some embodiments, each barcode is bound to a specific binder expressed on a phage. In some embodiments, a method further comprises obtaining a sample from an animal to subject to an assessment.

In some embodiments, a method as described herein comprises determining relative amounts of each binder present in a sample, thereby identifying a subset of an injected population of barcoded payloads (e.g. barcoded proteins) present in a sample. In some embodiments, a method as described herein comprises comparing relative amounts to a standard of known concentration to determine an absolute quantity of each binder present in a sample.

In some embodiments, a method as described herein comprises optionally, repeating steps one or more of method steps described herein using an identified subset of payloads (e.g. proteins).

In some embodiments, a method as described herein comprises identifying one or more payloads (e.g. proteins) as a therapeutic or a target to treat a disease, disorder, or condition.

In some embodiments, a method as described herein comprises removing any unassociated (e.g. unbound) binders. In some embodiments, removing may be performed by washing.

In some embodiments, barcoded payloads (e.g. barcoded proteins) are in a sample. In some embodiments, barcoded payloads (e.g. barcoded proteins) are in a complex sample. In some embodiments, barcoded payloads (e.g. barcoded proteins) are in a complex mixture. In some embodiments, barcoded payloads (e.g. barcoded proteins) are in a purified sample.

In some embodiments, a sample is or comprises one or more of serum, blood, tissue, or a tumor. In some embodiments, a sample is a control (e.g. positive control or negative control).

In some embodiments, a sample is a complex sample. In some embodiments, a complex sample is or comprises a tissue. In some embodiments, a complex sample is or comprises blood. In some embodiments, a complex sample is a complex mixture. In some embodiments, a complex sample is or comprises one or more of serum, blood, or tissue.

In some embodiments, a barcode is or comprises one or more amino acids. In some embodiments, a barcode is comprised in a Complementarity-Determining Regions (CDR) of a payload (e.g. a protein). In some embodiments, a barcode is synthetic. In some embodiments, a barcode is 1-100, 5-50, 8-25, 9-25, or 9-15 amino acids in length. In some embodiments, a barcode is 10 amino acids in length. In some embodiments, a barcode has relatively no effect on payload (e.g. a protein) function. In some embodiments, a barcode does not illicit an immune response. In some embodiments, barcodes are orthogonal to each other. In some embodiments, at least one barcode is linked with a polypeptide (e.g. a polypeptide binder, a payload) of interest.

In some embodiments, a barcode is attached to a payload (e.g. a protein). In some embodiments, a barcode is attached to an optimal position on a payload (e.g. a protein). In some embodiments, an optimal position is a N-terminus or a C-terminus.

In some embodiments, a binder is or comprises a binding moiety displayed on a phage. In some embodiments, each binder of a set of binders is expressed on a phage. In some embodiments, a binder is expressed on a surface of a phage particle.

In some embodiments, a phage is selected from a group consisting of M13, T4, T7, Lambda, and filamentous phage. In some embodiments, a phage is M13.

The present disclosure provides, among other things, a nucleic acid whose nucleotide sequence is or comprises a sequence encoding a peptide barcode. In some embodiments, a peptide barcode has a length within a range of 1 to 100, 5 to 50, 8 to 25, 9 to 25, or 9 to 15 amino acids. In some embodiments, a peptide barcode has a length of 8 to 25 amino acids. In some embodiments, a peptide barcode has a length of 10 amino acids. In some embodiments, a peptide barcode has been determined to bind specifically to a particular group of polypeptide binders within a set of binders.

In some embodiments, a peptide barcode has an amino acid sequence selected from a group consisting of SEQ ID NOs: 5347-8398. In some embodiments, an encoding sequence is selected from a group consisting of SEQ ID NOs: 1148-4199.

The present disclosure provides a library comprising a plurality of nucleic acids. In some embodiments, a plurality of nucleic acids together encodes a collection of peptide barcodes. In some embodiments, each nucleic acid comprises, in order from 5' to 3' or 3' to 5', one or more of: a) a first invariant sequence (e.g. a linker sequence or a payload sequence); b) a variant sequence that is at least 9 nucleotides long, and c) a second invariant sequence (e.g. a linker sequence, a stop codon, or a payload sequence).

In some embodiments, a variant sequence is at least 15, 24, 27, 45, 150, or 300, nucleotides long.

In some embodiments, a library further comprises one or more of: d) sequence contains short helical motif; e) sequence contains a disordered motif; f) an invariant sequence which links sequence to protein of interest.

In some embodiments, each peptide barcode of a collection binds specifically to a particular group of polypeptide binders within a set of binders. In some embodiments, each peptide barcode of a collection binds specifically to one or more polypeptide binders within a set of binders.

The present disclosure provides a nucleic acid whose nucleotide sequence is or comprises a sequence encoding a polypeptide binder moiety. In some embodiments, a polypeptide binder moiety has a length within a range of 10 to 400 amino acids. In some embodiments, a polypeptide binder moiety has been determined to bind specifically to a particular group of peptide barcodes within a collection of barcodes.

In some embodiments, a polypeptide binder moiety has an amino acid sequence selected from a group consisting of SEQ ID NOs: 4200-5346. In some embodiments, an encoding sequence is selected from a group consisting of SEQ ID NOs: 1-1147.

The present disclosure provides a library comprising a plurality of nucleic acids. In some embodiments, a plurality together encodes a set of polypeptide binder moieties. In some embodiments, each nucleic acid comprises, in order from 5' to 3' or 3' to 5': a) a first invariant sequence (e.g. an antibody germline sequence (e.g. IGHV/IGKV)); b) a first variant sequence that is at least 10 nucleotides long (e.g. a CDR (e.g. CDR3) sequence); and c) a second invariant sequence (e.g. an antibody germline sequence (e.g. IDHJ/IGKJ)).

In some embodiments, each nucleic acid further comprises one or more of: d) a stop codon (e.g. after a second invariant sequence); e) a linker sequence; f) a third invariant sequence (e.g. an antibody germline sequence (e.g. IGHV/IGKV)); g) a second variant sequence that is at least 10 nucleotides long (e.g. a CDR (e.g. CDR3) sequence); and h) a fourth invariant sequence (e.g. an antibody germline sequence (e.g. IDHJ/IGKJ)).

The present disclosure provides, among other things, a library of phage particles, each phage particle comprising one or more nucleic acids as described herein.

In some embodiments, a phage is selected from a group consisting of M13, T4, T7, Lambda. and filamentous phage. In some embodiments, a phage is M13.

The present disclosure provides a set of barcode and binders. In some embodiments, each barcode is a peptide between 1 to 100, 5 to 50, 8 to 25, 9 to 25, or 9 to 15 amino acids in length that binds specifically to a particular group of binders among binders in a set. In some embodiments, each binder is a polypeptide that binds specifically to at least one barcode among barcodes in a set.

In some embodiments, specific binding is observed when binders are expressed on phage that are contacted with barcodes. In some embodiments, each binder is expressed on a phage.

The present disclosure provides a kit comprising a set of binders, each of which is a polypeptide that binds specifically to at least a particular peptide barcode in a collection barcodes. In some embodiments, each binder is provided as a polypeptide, a nucleic acid encoding a polypeptide, or both. In some embodiments, one or more of binders is provided as a phage particle, or collection thereof, engineered to express a binder. In some embodiments, one or more of binders is provided as a nucleic acid in a phagemid vector, or as an insert suitable for cloning into a phage vector.

In some embodiments, a kit further comprises information designating peptide barcodes for each binder. In some embodiments, each binder has been determined to bind specifically to at least a particular peptide barcode within a collection of barcodes that each bind specifically to at least one binder in a set.

In some embodiments, a kit further comprises a set of instructions to perform sequencing of one or more phage particles bound to one or more barcodes. In some embodiments, a kit further comprises a computer readable program for decoding sequencing data. In some embodiments, a kit further comprises reagents to express a binder on a phage particle.

In some embodiments, a kit comprises nucleic acids that encode one or more barcodes. In some embodiments, a kit comprises nucleic acids that encode one or more binders.

The present disclosure provides a method of pharmacokinetic screening. In some embodiments, a method comprises injecting a set of barcoded therapeutic candidate proteins into an animal. In some embodiments, each barcoded therapeutic candidate protein comprises a specific peptide barcode. In some embodiments, a method comprises obtaining a sample from an animal; purifying one or more barcoded therapeutic candidate proteins from a sample; contacting a sample with a set of binders (e.g. binding agents with binders expressed on them) which includes at least one particular binder specific for each barcode in a sample; and determining relative amounts of each binder present in a sample to determine each barcoded therapeutic candidate proteins' pharmacokinetic properties or biodistribution.

In some embodiments, purified proteins may be a subset of barcoded therapeutic candidate proteins which are injected into an animal.

In some embodiments, multiple samples may be obtained from an animal.

In some embodiments, an animal is a mammal. In some embodiments, an animal is a human. In some embodiments, an animal is genetically modified to express barcoded payloads (e.g. barcoded proteins).

In some embodiments, an animal is a model for a disease, disorder, or condition. In some embodiments, a disease, disorder, or condition is cancer, autoimmune, neurodegenerative, or a pathogenic (e.g. viral/bacterial) disease, disorder, or condition.

In some embodiments, a step of determining comprises (i) sequencing nucleic acid from binding agents expressing a binder; (ii) decoding relative amounts of each barcode present thereby determining relative amounts of each therapeutic candidate protein; and/or (iii) performing one or more of FACS, or MACS (magnetic activated cell sorting), affinity based purification.

In some embodiments, a step of determining comprises quantifying number of binders that bind to a barcoded payload (e.g. barcoded protein (e.g. barcoded therapeutic protein)). In some embodiments, quantifying is performed by decoding a nucleotide sequence of each binder that binds to a barcoded payload (e.g. barcoded protein).

In some embodiments, a number of nucleotide sequences provides a measure of payload (e.g. target protein) in a population of barcoded payloads (e.g. barcoded proteins).

In some embodiments, a step of injecting comprises administering barcoded payloads (e.g. barcoded proteins, barcoded therapeutic candidate proteins, etc.) orally or intravenously. In some embodiments, barcoded payloads (e.g. barcoded proteins) are injected (e.g. delivered) by viral delivery or mRNA delivery.

The present disclosure provides a method of characterizing a collection of peptide barcodes comprising: providing: (i) a library of phage particles, wherein each phage particle is designed to express a polypeptide binder, and wherein each binder binds to one or more peptide barcodes; (ii) a collection of peptide barcodes; contacting each phage particle with each barcode to form bound phage-barcode particles; determining an amount of binding between each phage particle and barcode; and identifying phage-barcode pairs that bind specifically to each other among barcodes in a collection and phages in a library.

The present disclosure provides a method of characterizing a collection of peptide barcodes comprising: providing: (i) a set of binders, wherein each binder is a polypeptide that binds to one or more peptide barcodes; (ii) a collection of peptide barcodes; contacting each binder with each barcode to form bound binder-barcode particles; determining a relative amount of binding between each polypeptide binder and peptide barcode; and identifying binder-barcode pairs that bind specifically to each other among barcodes in a collection and binders in a set.

The present disclosure provides a database of amino acid or encoding nucleic acid sequences for a collection of peptide barcodes, which database is embodied in a computer readable format. In some embodiments, each barcode sequence has a length within a range of 1 to 100, 5 to 50, 8 to 25, 9 to 25, or 9 to 15 amino acids. In some embodiments, each barcode sequence has been determined to bind specifically to one or more polypeptide binders within a set of binders that each bind specifically to one or more of barcodes in a collection.

In some embodiments, a binding pattern of one or more polypeptide binders to a barcode is used to identify a peptide barcode.

The present disclosure provides a database of amino acid or encoding nucleic acid sequences for a set of polypeptide binders. In some embodiments, a database is embodied in a computer readable format. In some embodiments, each binder sequence has a length within a range of 10 to 400 amino acids. In some embodiments, each binder sequence has been determined to bind specifically to one or more peptide barcodes within a collection of barcodes that each bind specifically to one or more of binders in a set.

The present disclosure provides, among other things, a database of amino acid or encoding nucleic acid sequences for a set of barcode-binder associations, embodied in a computer readable format. In some embodiments, each barcode is a peptide between 1 to 100, 5 to 50, 8 to 25, 9 to 25, or 9 to 15 amino acids in length. In some embodiments, each binder is a polypeptide that binds specifically to one or more barcodes among barcodes in a set.

The present disclosure provides a set of barcode-binder association designations, embodied in a computer readable format. In some embodiments, each barcode is a peptide between 1 to 100, 5 to 50, 8 to 25, 9 to 25, or 9 to 15 amino acids in length. In some embodiments, each binder is a polypeptide that binds specifically to one or more barcodes among barcodes in a set.

In some embodiments, specific binding is observed when binders are expressed on a phage particle that are then contacted with barcodes.

The present disclosure provides a method of treatment using technologies described herein. In some embodiments, a method comprises administering a therapeutic protein that has been determined to satisfy an assessment. In some embodiments, satisfying an assessment may be by a process comprising steps of: a) subjecting a population of barcoded proteins to an assessment; b) separating those members of a population that satisfy an assessment from those that do not, so that either a positive population or a negative population, or both is identified; c) contacting a positive population, or a negative population, or each population separately from the other, with a set of binders which includes at least one particular binder specific for each barcode in a population; d) determining which binders bind to separated members, thereby determining which barcoded proteins are present in a contacted population(s); and e) identifying a therapeutic protein from barcoded proteins determined to be present in a contacted population(s).

The present disclosure provides a method of treatment comprising administering a therapeutic protein that has been determined to satisfy an assessment by a process comprising steps of: a) contacting a set of binders either with a first population, with a second population, or separately with each of a first and second populations, of barcoded proteins; b) determining which binders of a set bind to a member of a first population, a second population, or both, thereby determining which barcoded proteins are present in a contacted population(s); and c) identifying a therapeutic protein from barcoded proteins determined to be present in a contacted population(s). In some embodiments, each binder binds specifically to one or more barcode relative to other barcodes. In some embodiments, a set of binders, collectively, includes a binder specific for each barcode in a first and second populations. In some embodiments, a first and second populations have been separated from one another based on performance in an assessment.

These, and other aspects encompassed by the present disclosure, are described in more detail below and in the claims.

BRIEF DESCRIPTION OF THE DRAWING

FIG. 3B is a schematic for capturing a barcode as described herein, so that it may be contacted by a binding agent as described herein, according to an illustrative embodiment. It is a schematic of a barcode-binder platform as described herein, according to an illustrative embodiment. The schematic shows a magnetic bead with a bead binding domain conjugated to a universally tagged (e.g. HALO, Chitin BD, Avitag (Strep), etc.) barcoded payload. To detect the captured barcoded payload, a binding agent (e.g. phage expressing a binder on its surface (e.g. phage with binder DNA/lib)) with known affinity to the barcode is bound to the immobilized payload. The DNA within the phage that encodes for the binder is then amplified and subjected to NGS to detect the payload.

FIG. 6C discloses SEQ ID NOS. 8400-8413, respectively, in order of appearance.

(C) shows the results of determination of absolute concentration for 6 different barcodes. The plots show known input concentrations (left bar) and measured concentration (right bar) for six (6) different barcodes.

Figure 11:
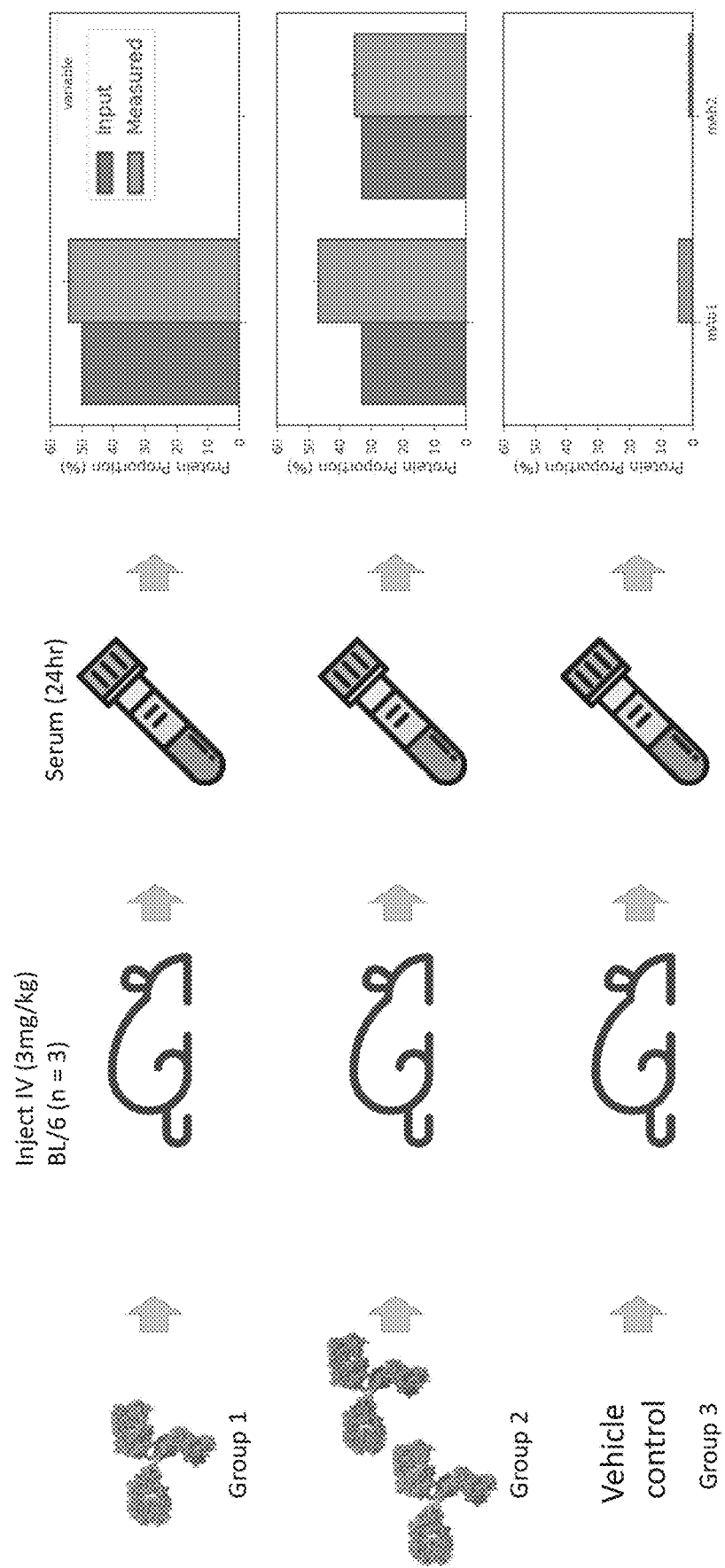

FIG. 11 shows a method for determining the relative abundance of two proteins after injection in vivo, using the binder-barcode system described herein according to an illustrative embodiment. The figure shows a graphical depiction of experimental setup. In group 1 (top), mice were injected with 1 barcoded payload. In group 2 (middle), 2 barcoded payloads were injected. In group 3 (bottom), no barcoded payloads were injected. For each of the three groups, at 24 hours, a serum sample was taken; the barcoded payload(s) captured using binding agents as described herein, and subjected to decoding. The measured barcoded payload concentrations (right bar) compared to known input concentrations (left bar) for each group are shown.

Figure 12:
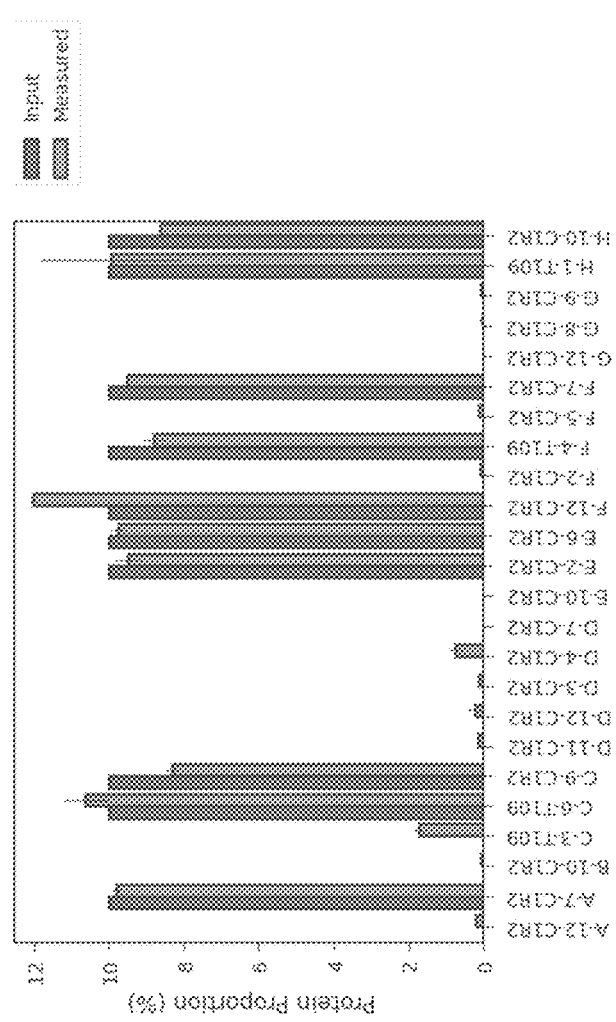
Figure 12:
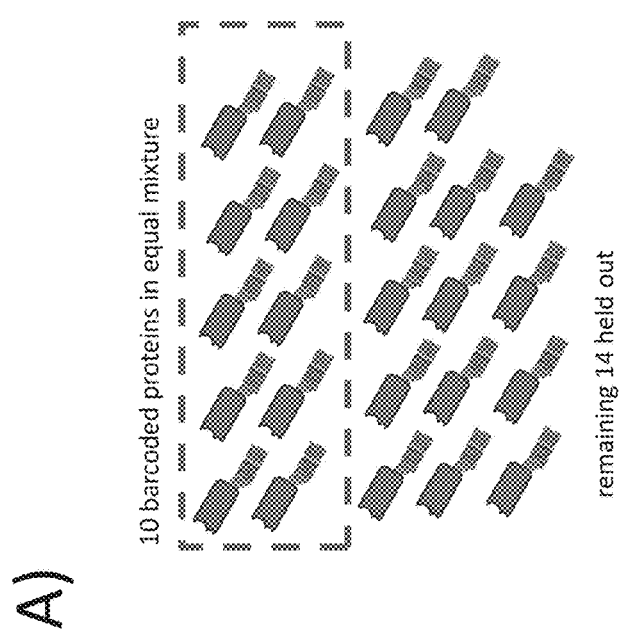

FIG. 12 shows determination of up to 24 barcodes contained within a single mixture. (A) shows a graphical depiction of the experiment. Of 24 total barcodes the algorithm can predict, 10 were present within a mixture at equal concentrations. The rest were held out from the pool, but prediction was computationally allowed. Three (3) separate pools, which cover all possible barcodes were measured in replicate. (B) shows prediction for the first pool. Input concentration (left bar) and measured concentration (right bar) are displayed. (C) shows predictions across all three pools. As in B, input concentration is left bar and measured is right bar. (D) shows the barcode fingerprint for the 24 barcodes used to computationally determine the relative abundance of the barcodes within the 3 pools. Columns represent barcode fingerprints, and rows represent binding agent fingerprints. FIG. 12D discloses SEQ ID NOS. 8414, 8415, 8414, 8416, 8414, 8413, 8414, 8417, 8414, 8418, 8414, 8419, 8414, 8420-8425, 8422, 8426, 8427, 8426, 8428-8431, 8430, 8432, 8433, 8432, 8434, 8432, 8435, 8432, 8430, 8432, 8436-8453, 8413, 8453, 8454, 8453, 8455-8475, 8474, 8476-8480, 8479, 8481-8484, 8483, 8484-8493, 8472, 8494, 8472, 8495, 8472, 8496, 8472, 8497, 8472, 8498-8502, 8501, 8503-8505, 8504, 8506, 8504, 8507, 8504, 8508-8516, 8515, 8517, 8518, 8417, 8519, 8520, 8519, 8521-8532, 8403, 8533-8542, 8541, 8543-8545, 8544, 8546, 8544, 8547, 8544, 8548-8552, 8551, 8553, 8551, 8554-8562, respectively, in order of appearance. (E) shows the binding agent counts from the three pools, used to computationally determine the proportion of the pools. Rows are the binding agent counts, columns are the pools, the cell is the binding agent count within a specific pool. FIG. 12E discloses SEQ ID NOS. 8414, 8415, 8414, 8416, 8414, 8413, 8414, 8417, 8414, 8418, 8414, 8419, 8414, 8420-8425, 8422, 8426, 8427, 8426, 8428-8431, 8430, 8432, 8433, 8432, 8434, 8432, 8435, 8432, 8430, 8432, 8436-8453, 8413, 8453, 8454, 8453, 8455-8475, 8474, 8476-8480, 8479, 8481-8484, 8483, 8484-8493, 8472, 8494, 8472, 8495, 8472, 8496, 8472, 8497, 8472, 8498-8502, 8501, 8503-8505, 8504, 8506, 8504, 8507, 8504, 8508-8516, 8515, 8517, 8518, 8417, 8519, 8520, 8519, 8521-8532, 8403, 8533-8542, 8541, 8543-8545, 8544, 8546, 8544, 8547, 8544, 8548-8552, 8551, 8553, 8551, 8554-8562, respectively, in order of appearance.

DEFINITIONS

About: The term "about", w % ben used herein in reference to a value, refers to a value that is similar, in context to the referenced value. In general, those skilled in the art, familiar with the context, will appreciate the relevant degree of variance encompassed by "about" in that context. For example, in some embodiments, the term "about" may encompass a range of values that within 25%, 20%, 19%, 18%, 17%, 16%, 15%, 14%, 13%, 12%, 11%, 10%, 9%, 8%, 7%, 6%, 5%, 4%, 3%, 2%, 1%, or less of the referred value.

Affinity: As is known in the art, "affinity" is a measure of the tightness with which two or more binding partners associate with one another. Those skilled in the art are aware of a variety of assays that can be used to assess affinity, and will furthermore be aware of appropriate controls for such assays. In some embodiments, affinity is assessed in a quantitative assay. In some embodiments, affinity is assessed over a plurality of concentrations (e.g., of binding partner at a time). In some embodiments, affinity is assessed in the presence of one or more potential competitor entities (e.g., that might be present in a relevant—e.g., physiological—setting). In some embodiments, affinity is assessed relative to a reference (e.g., that has a known affinity above a particular threshold [a "positive control" reference] or that has a known affinity below a particular threshold [a "negative control" reference" ]. In some embodiments, affinity may be assessed relative to a contemporaneous reference; in some embodiments, affinity may be assessed relative to a historical reference. Typically, when affinity is assessed relative to a reference, it is assessed under comparable conditions.

Agent: In general, the term "agent", as used herein, is used to refer to an entity (e.g., for example, a lipid, metal, nucleic acid, polypeptide, polysaccharide, small molecule, etc, or complex, combination, mixture or system [e.g., cell, tissue, organism] thereof), or phenomenon (e.g., heat, electric current or field, magnetic force or field, etc.). In appropriate circumstances, as will be clear from context to those skilled in the art, the term may be utilized to refer to an entity that is or comprises a cell or organism, or a fraction, extract, or component thereof. Alternatively or additionally, as context will make clear, the term may be used to refer to a natural product in that it is found in and/or is obtained from nature. In some instances, again as will be clear from context, the term may be used to refer to one or more entities that is man-made in that it is designed, engineered, and/or produced through action of the hand of man and/or is not found in nature. In some embodiments, an agent may be utilized in isolated or pure form; in some embodiments, an agent may be utilized in crude form. In some embodiments, potential agents may be provided as collections or libraries, for example that may be screened to identify or characterize active agents within them. In some cases, the term "agent" may refer to a compound or entity that is or comprises a polymer; in some cases, the term may refer to a compound or entity that comprises one or more polymeric moieties. In some embodiments, the term "agent" may refer to a compound or entity that is not a polymer and/or is substantially free of any polymer and/or of one or more particular polymeric moieties. In some embodiments, the term may refer to a compound or entity that lacks or is substantially free of any polymeric moiety.

Amino acid: in its broadest sense, as used herein, refers to any compound and/or substance that can be incorporated into a polypeptide chain, e.g., through formation of one or more peptide bonds. In some embodiments, an amino acid has the general structure $H_2N$—$C(H)(R)$—$COOH$. In some embodiments, an amino acid is a naturally-occurring amino acid. In some embodiments, an amino acid is a non-natural amino acid; in some embodiments, an amino acid is a D-amino acid; in some embodiments, an amino acid is an L-amino acid. "Standard amino acid" refers to any of the twenty standard L-amino acids commonly found in naturally occurring peptides. "Nonstandard amino acid" refers to any amino acid, other than the standard amino acids, regardless of whether it is prepared synthetically or obtained from a natural source. In some embodiments, an amino acid, including a carboxy- and/or amino-terminal amino acid in a polypeptide, can contain a structural modification as compared with the general structure above. For example, in some embodiments, an amino acid may be modified by methylation, amidation, acetylation, pegylation, glycosylation, phosphorylation, and/or substitution (e.g., of the amino group, the carboxylic acid group, one or more protons, and/or the hydroxyl group) as compared with the general structure. In some embodiments, such modification may, for example, alter the circulating half-life of a polypeptide containing the modified amino acid as compared with one containing an otherwise identical unmodified amino acid. In some embodiments, such modification does not significantly alter a relevant activity of a polypeptide containing the modified amino acid, as compared with one containing an otherwise identical unmodified amino acid. As will be clear from context, in some embodiments, the term "amino acid" may be used to refer to a free amino acid; in some embodiments it may be used to refer to an amino acid residue of a polypeptide.

Animal: as used herein refers to any member of the animal kingdom. In some embodiments, "animal" refers to humans, of either sex and at any stage of development. In some embodiments. "animal" refers to non-human animals, at any stage of development. In certain embodiments, the non-human animal is a mammal (e.g., a rodent, a mouse, a rat, a rabbit, a monkey, a dog, a cat, a sheep, cattle, a primate, and/or a pig). In some embodiments, animals include, but are not limited to, mammals, birds, reptiles, amphibians, fish, insects, and/or worms. In some embodiments, an animal may be a transgenic animal, genetically engineered animal, and/or a clone.

Antibody: As used herein, the term "antibody" refers to a polypeptide that includes canonical immunoglobulin sequence elements sufficient to confer specific binding to a particular target antigen. As is known in the art, intact antibodies as produced in nature are approximately 150 kD tetrameric agents comprised of two identical heavy chain polypeptides (about 50 kD each) and two identical light chain polypeptides (about 25 kD each) that associate with each other into what is commonly referred to as a "Y-shaped" structure. Each heavy chain is comprised of at least four domains (each about 110 amino acids long)- an amino-terminal variable (VH) domain (located at the tips of the Y structure), followed by three constant domains: CH1, CH2, and the carboxy-terminal CH3 (located at the base of the Y's stem). A short region, known as the "switch", connects the heavy chain variable and constant regions. The "hinge" connects CH2 and CH3 domains to the rest of the antibody. Two disulfide bonds in this hinge region connect the two heavy chain polypeptides to one another in an intact antibody. Each light chain is comprised of two domains—an amino-terminal variable (VL) domain, followed by a carboxy-terminal constant (CL) domain, separated from one another by another "switch". Intact antibody tetramers are comprised of two heavy chain-light chain dimers in which the heavy and light chains are linked to one another by a single disulfide bond; two other disulfide bonds connect the heavy chain hinge regions to one another, so that the dimers are connected to one another and the tetramer is formed. Naturally-produced antibodies are also glycosylated, typically on the CH2 domain. Each domain in a natural antibody has a structure characterized by an "immunoglobulin fold" formed from two beta sheets (e.g., 3-, 4-, or 5-stranded sheets) packed against each other in a compressed antiparallel beta barrel. Each variable domain contains three hypervariable loops known as "complement determining regions" (CDR1, CDR2, and CDR3) and four somewhat invariant "framework" regions (FR1, FR2, FR3, and FR4). When natural antibodies fold, the FR regions form the beta sheets that provide the structural framework for the domains, and the CDR loop regions from both the heavy and light chains are brought together in three-dimensional space so that they create a single hypervariable antigen binding site located at the tip of the Y structure. The Fc region of naturally-occurring antibodies binds to elements of the complement system, and also to receptors on effector cells, including for example effector cells that mediate cytotoxicity. As is known in the art, affinity and/or other binding attributes of Fc regions for Fc receptors can be modulated through glycosylation or other modification. In some embodiments, antibodies produced and/or utilized in accordance with the present invention include glycosylated Fc domains, including Fc domains with modified or engineered such glycosylation. For purposes of the present invention, in certain embodiments, any polypeptide or complex of polypeptides that includes sufficient immunoglobulin domain sequences as found in natural antibodies can be referred to and/or used as an "antibody", whether such polypeptide is naturally produced (e.g., generated by an organism reacting to an antigen), or produced by recombinant engineering, chemical synthesis, or other artificial system or methodology. In some embodiments, an antibody is polyclonal; in some embodiments, an antibody is monoclonal. In some embodiments, an antibody has constant region sequences that are characteristic of mouse, rabbit, primate, or human antibodies. In some embodiments, antibody sequence elements are humanized, primatized, chimeric, etc, as is known in the art. Moreover, the term "antibody" as used herein, can refer in appropriate embodiments (unless otherwise stated or clear from context) to any of the art-known or developed constructs or formats for utilizing antibody structural and functional features in alternative presentation. For example, embodiments, an antibody utilized in accordance with the present invention is in a format selected from, but not limited to, intact IgA, IgG, IgE or IgM antibodies; bi- or multi-specific antibodies (e.g., Zybodies®, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies (e.g., shark single domain antibodies such as IgNAR or fragments thereof); cameloid antibodies; masked antibodies (e.g., Probodies®); Small Modular Immuno Pharmaceuticals ("SMIPs™"); single chain or Tandem diabodies (TandAb®); VHHs; Anticalins®; Nanobodies® minibodies; BiTE®s; ankyrin repeat proteins or DARPiNs®; Avimers®; DARTs; TCR-like antibodies; Adnectins®; Affilins®; Trans-Bodies®; Affibodies®; TrimerX®; MicroProteins; Fynomers®, Centyrins®; and KALBITOR®s. In some embodiments, an antibody may lack a covalent modification (e.g., attachment of a glycan) that it would have if produced naturally. In some embodiments, an antibody may contain a covalent modification (e.g., attachment of a glycan, a payload [e.g., a detectable moiety, a therapeutic moiety, a catalytic moiety, etc], or other pendant group [e.g., polyethylene glycol, etc.]

Antibody agent: As used herein, the term "antibody agent" refers to an agent that specifically binds to a particular antigen. In some embodiments, the term encompasses any polypeptide or polypeptide complex that includes immunoglobulin structural elements sufficient to confer specific binding. Exemplary antibody agents include, but are not limited to monoclonal antibodies or polyclonal antibodies. In some embodiments, an antibody agent may include one or more constant region sequences that are characteristic of mouse, rabbit, primate, or human antibodies. In some embodiments, an antibody agent may include one or more sequence elements are humanized, primatized, chimeric, etc, as is known in the art. In many embodiments, the term "antibody agent" is used to refer to one or more of the art-known or developed constructs or formats for utilizing antibody structural and functional features in alternative presentation. For example, embodiments, an antibody agent utilized in accordance with the present invention is in a format selected from, but not limited to, intact IgA, IgG, IgE or IgM antibodies; bi- or multi-specific antibodies (e.g., Zybodies®, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies (e.g., shark single domain antibodies such as IgNAR or fragments thereof); cameloid antibodies; masked antibodies (e.g., Probodies®); Small Modular Immuno Pharmaceuticals ("SMIPs™"); single chain or Tandem diabodies (TandAb®); VHHs; Anticalins®; Nanobodies® minibodies; BiTE®s; ankyrin repeat proteins or DARPINs®; Avimers®; DARTs; TCR-like antibodies; Adnectins®; Affilins; TransBodies®; Affibodies®; TrimerX®; MicroProteins; Fynomers®, Centyrins®; and KALBITOR®s. In some embodiments, an antibody may lack a covalent modification (e.g., attachment of a glycan) that it would have if produced naturally. In some embodiments, an antibody may contain a covalent modification (e.g., attachment of a glycan, a payload [e.g., a detectable moiety, a therapeutic moiety, a catalytic moiety, etc], or other pendant group [e.g., polyethylene glycol, etc.]. In many embodiments, an antibody agent is or comprises a polypeptide whose amino acid sequence includes one or more structural elements recognized by those skilled in the art as a complementarity determining region (CDR); in some embodiments an antibody agent is or comprises a polypeptide whose amino acid sequence includes at least one CDR (e.g., at least one heavy chain CDR and/or at least one light chain CDR) that is substantially identical to one found in a reference antibody. In some embodiments an included CDR is substantially identical to a reference CDR in that it is either identical in sequence or contains between 1-5 amino acid substitutions as compared with the reference CDR. In some embodiments an included CDR is substantially identical to a reference CDR in that it shows at least 85%, 86%, 87%, 88%, 89%, 90%, 91%, 92%, 93%, 94%, 95%, 96%, 97%, 98%, 99%, or 100% sequence identity with the reference CDR. In some embodiments an included CDR is substantially identical to a reference CDR in that it shows at least 96%, 96%, 97%, 98%, 99%, or 100% sequence identity with the reference CDR. In some embodiments an included CDR is substantially identical to a reference CDR in that at least one amino acid within the included CDR is deleted, added, or substituted as compared with the reference CDR but the included CDR has an amino acid sequence that is otherwise identical with that of the reference CDR. In some embodiments an included CDR is substantially identical to a reference CDR in that 1-5 amino acids within the included CDR are deleted, added, or substituted as compared with the reference CDR but the included CDR has an amino acid sequence that is otherwise identical to the reference CDR. In some embodiments an included CDR is substantially identical to a reference CDR in that at least one amino acid within the included CDR is substituted as compared with the reference CDR but the included CDR has an amino acid sequence that is otherwise identical with that of the reference CDR. In some embodiments an included CDR is substantially identical to a reference CDR in that 1-5 amino acids within the included CDR are deleted, added, or substituted as compared with the reference CDR but the included CDR has an amino acid sequence that is otherwise identical to the reference CDR. In some embodiments, an antibody agent is or comprises a polypeptide whose amino acid sequence includes structural elements recognized by those skilled in the art as an immunoglobulin variable domain. In some embodiments, an antibody agent is a polypeptide protein having a binding domain which is homologous or largely homologous to an immunoglobulin-binding domain.

Associated: Two events or entities are "associated" with one another, as that term is used herein, if the presence, level, degree, type and/or form of one is correlated with that of the other. For example, a particular entity (e.g., polypeptide, genetic signature, metabolite, microbe, etc) is considered to be associated with a particular disease, disorder, or condition, if its presence, level and/or form correlates with incidence of and/or susceptibility to the disease, disorder, or condition (e.g., across a relevant population). In some embodiments, two or more entities are physically "associated" with one another if they interact, directly or indirectly, so that they are and/or remain in physical proximity with one another. In some embodiments, two or more entities that are physically associated with one another are covalently linked to one another; in some embodiments, two or more entities that are physically associated with one another are not covalently linked to one another but are non-covalently associated, for example by means of hydrogen bonds, van der Waals interaction, hydrophobic interactions, magnetism, and combinations thereof.

Barcode: As used herein, the term "barcode" refers to a peptide sequence, which associates with a binder with known specificity and affinity. In some embodiments, a barcode binds to a specific antibody-agent. In some embodiments, a barcode may be contained within a specific payload of interest. In some embodiments, a barcode may be terminal to a specific payload of interest. In some embodiments, a barcode may be synthetic. In some embodiments, a barcode may be designed. For example, a barcode sequence may be ordered as a DNA polynucleotide and cloned into the payload of interest using methods of molecular cloning known to a person of ordinary skill in the art.

Binder: As used herein, the term "binder" or "binder moiety" refers to a polypeptide sequence, which associates with a barcode with known specificity and affinity. In some embodiments, a binder is or comprises an antibody agent. In some embodiments, a binder is expressed on a surface of a binding agent. In some embodiments, a binder may bind to one or more barcodes.

Binding: It will be understood that the term "binding" or "bind", as used herein, typically refers to a non-covalent association between or among two or more entities. "Direct" binding involves physical contact between entities or moieties; indirect binding involves physical interaction by way of physical contact with one or more intermediate entities. Binding between two or more entities can typically be assessed in any of a variety of contexts—including where interacting entities or moieties are studied in isolation or in the context of more complex systems (e.g., while covalently or otherwise associated with a carrier entity and/or in a biological system or cell).

Binding agent: In general, the term "binding agent" is used herein to refer to any entity that binds to a target of interest as described herein (e.g. a barcode, a barcoded target, etc.). In many embodiments, a binding agent of interest is one that binds specifically with its target in that it discriminates its target from other potential binding partners in a particular interaction contect. In general, a binding agent may be or comprise an entity of any chemical class (e.g., polymer, non-polymer, small molecule, polypeptide, carbohydrate, lipid, nucleic acid, etc) or biological class (e.g. bacteria, phage, ribosome, mRNA. DNA, etc.). In some embodiments, a binding agent is a single chemical entity. In some embodiments, a binding agent is a complex of two or more discrete chemical entities associated with one another under relevant conditions by non-covalent interactions. For example, those skilled in the art will appreciate that in some embodiments, a binding agent may comprise a "generic" binding moiety (e.g., one of biotin/avidin/streptavidin and/or a class-specific antibody) and a "specific" binding moiety (e.g., an antibody or aptamers with a particular molecular target) that is linked to the partner of the generic biding moiety. In some embodiments, such an approach can permit modular assembly of multiple binding agents through linkage of different specific binding moieties with the same generic binding moiety partner. In some embodiments, binding agents are or comprise phages. In some embodiments, binding agents are or comprise polypeptides (including, e.g., antibodies or antibody fragments). In some embodiments, binding agents are or comprise small molecules. In some embodiments, binding agents are or comprise nucleic acids. In some embodiments, binding agents are or comprise aptamers. In some embodiments, binding agents are polymers; in some embodiments, binding agents are not polymers. In some embodiments, binding agents are non-polymeric in that they lack polymeric moieties. In some embodiments, binding agents are or comprise carbohydrates. In some embodiments, binding agents are or comprise lectins. In some embodiments, binding agents are or comprise peptidomimetics. In some embodiments, binding agents are or comprise scaffold proteins. In some embodiments, binding agents are or comprise mimeotopes. In some embodiments, binding agents are or comprise stapled peptides. In certain embodiments, binding agents are or comprise nucleic acids, such as DNA or RNA.

Biological Sample: As used herein, the term "biological sample" typically refers to a sample obtained or derived from a biological source (e.g., a tissue or organism or cell culture) of interest, as described herein. In some embodiments, a source of interest comprises an organism, such as an animal or human. In some embodiments, a biological sample is or comprises biological tissue or fluid. In some embodiments, a biological sample may be or comprise bone marrow, blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; feces, other body fluids, secretions, and/or excretions; and/or cells therefrom, etc. In some embodiments, a biological sample is or comprises cells obtained from an individual. In some embodiments, obtained cells are or include cells from an individual from whom the sample is obtained. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc.

CDR: As used herein, "CDR" refers to a complementarity determining region within an antibody variable region. There are three CDRs in each of the variable regions of the heavy chain and the light chain, which are designated CDR1. CDR2 and CDR3, for each of the variable regions. A "set of CDRs" or "CDR set" refers to a group of three or six CDRs that occur in either a single variable region capable of binding the antigen or the CDRs of cognate heavy and light chain variable regions capable of binding the antigen. Certain systems have been established in the art for defining CDR boundaries (e.g., Kabat, Chothia, etc.); those skilled in the art appreciate the differences between and among these systems and are capable of understanding CDR boundaries to the extent required to understand and to practice the claimed invention.

Comparable: As used herein, the term "comparable" refers to two or more agents, entities, situations, sets of conditions, that may not be identical to one another but that are sufficiently similar to permit comparison there between so that one skilled in the art will appreciate that conclusions may reasonably be drawn based on differences or similarities observed. In some embodiments, comparable sets of conditions, circumstances, individuals, or populations are characterized by a plurality of substantially identical features and one or a small number of varied features. Those of ordinary skill in the art will understand, in context, what degree of identity is required in any given circumstance for two or more such agents, entities, situations, sets of conditions, to be considered comparable. For example, those of ordinary skill in the art will appreciate that sets of circumstances, individuals, or populations are comparable to one another when characterized by a sufficient number and type of substantially identical features to warrant a reasonable conclusion that differences in results obtained or phenomena observed under or with different sets of circumstances, individuals, or populations are caused by or indicative of the variation in those features that are varied.

Comprising: A composition or method described herein as "comprising" one or more named elements or steps is open-ended, meaning that the named elements or steps are essential, but other elements or steps may be added within the scope of the composition or method. To avoid prolixity, it is also understood that any composition or method described as "comprising" (or which "comprises") one or more named elements or steps also describes the corresponding, more limited composition or method "consisting essentially of" (or which "consists essentially of") the same named elements or steps, meaning that the composition or method includes the named essential elements or steps and may also include additional elements or steps that do not materially affect the basic and novel characteristic(s) of the composition or method. It is also understood that any composition or method described herein as "comprising" or "consisting essentially of" one or more named elements or steps also describes the corresponding, more limited, and closed-ended composition or method "consisting of" (or "consists of") the named elements or steps to the exclusion of any other unnamed element or step. In any composition or method disclosed herein, known or disclosed equivalents of any named essential element or step may be substituted for that element or step.

Decoding: As used herein, the term "decoding", refers to a laboratory and/or bioinformatics process of identifying and quantifying a unique set of amino acids within a barcode. In some embodiments, such identification and quantification is achieved using nucleic acid (e.g. DNA) counts form a sequencing experiment and measuring an abundance of binder counts. In some embodiments, previously measured fingerprints (e.g. binder fingerprint or barcode fingerprint) are used to determine the relationship between an unknown barcode mixture, which is being decoded, for example, by comparing to a previously known mixture's binder counts, across binders with known and varying affinities to several barcodes within the pool.

Designed: As used herein, the term "designed" refers to an agent (i) whose structure is or was selected by the hand of man, (ii) that is produced by a process requiring the hand of man; and/or (iii) that is distinct from natural substances and other known agents.

Determine: Many methodologies described herein include a step of "determining". Those of ordinary skill in the art, reading the present specification, will appreciate that such "determining" can utilize or be accomplished through use of any of a variety of techniques available to those skilled in the art, including for example specific techniques explicitly referred to herein. In some embodiments, determining involves manipulation of a physical sample. In some embodiments, determining involves consideration and/or manipulation of data or information, for example utilizing a computer or other processing unit adapted to perform a relevant analysis. In some embodiments, determining involves receiving relevant information and/or materials from a source. In some embodiments, determining involves comparing one or more features of a sample or entity to a comparable reference.

Engineered: In general, the term "engineered" refers to the aspect of having been manipulated by the hand of man. For example, in some embodiments, a small molecule may be considered to be engineered if its structure and/or production is designed and/or implemented by the hand of man. Analogously, in some embodiments, a polynucleotide may be considered to be "engineered" when two or more sequences, that are not linked together in that order in nature, are manipulated by the hand of man to be directly linked to one another in the engineered polynucleotide. For example, in some embodiments of the present invention, an engineered polynucleotide comprises a regulatory sequence that is found in nature in operative association with a first sequence (e.g. coding sequence) but not in operative association with a second sequence (e.g. coding sequence), is linked by the hand of man so that it is operatively associated with the second sequence. Comparably, a cell or organism is considered to be "engineered" if it has been manipulated so that its genetic information is altered (e.g., new genetic material not previously present has been introduced, for example by transformation, mating, somatic hybridization, transfection, transduction, or other mechanism, or previously present genetic material is altered or removed, for example by substitution or deletion mutation, or by mating protocols). As is common practice and is understood by those in the art, expression products of an engineered polynucleotide, and/or progeny of an engineered polynucleotide or cell are typically still referred to as "engineered" even though the actual manipulation was performed on a prior entity.

Expression: As used herein, "expression" of a nucleic acid sequence refers to one or more of the following events; (1) production of an RNA template from a DNA sequence (e.g., by transcription); (2) processing of an RNA transcript (e.g., by splicing, editing, 5' cap formation, and/or 3' end formation); (3) translation of an RNA into a polypeptide or protein, and/or (4) post-translational modification of a polypeptide or protein.

Fingerprint: As used herein, the term "fingerprint" refers to the counts of one or more unknown agents that a known agent may bind to or be associated with. In some embodiments, a fingerprint may be for a known barcode or barcode mixture. In some embodiments, a fingerprint may be for a known binder or binder mixture. For example, in some embodiments, a fingerprint (e.g. barcode fingerprint) may refer to the counts of one or more binders (e.g. determined through sequencing analysis) to bind specifically to a known barcode or barcode mixture. That is, in some embodiments, a fingerprint for a barcode refers to the counts of one or more binders, some of which may have high affinity for the barcode, and some of which may have low affinity for the barcode. In some embodiments, a fingerprint may be used in the decoding process, which process is used to determine the relative or absolute abundance of a given barcode within a pool of barcodes. As is understood to a person of ordinary skill in the art a fingerprint may be determined for a known barcode or barcode mixture, or for a known binder or binder mixture. For example, in some embodiments, a fingerprint (e.g. binder fingerprint) may refer to the counts of one or more barcodes (e.g. determined through sequencing analysis) that bind specifically to a known binder or binder mixture. That is, in some embodiments, a fingerprint for a binder refers to the counts of one or more barcodes, some of which may have high affinity for the binder, and some of which may have low affinity for the binder. Accordingly, a fingerprint may also be used in the decoding process, in some embodiments, to determine the relative or absolute abundance of a given binder within a pool of binders.

Fragment: A "fragment" of a material or entity as described herein has a structure that includes a discrete portion of the whole, but lacks one or more moieties found in the whole. In some embodiments, a fragment consists of such a discrete portion. In some embodiments, a fragment consists of or comprises a characteristic structural element or moiety found in the whole. In some embodiments, a polymer fragment comprises or consists of at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 275, 300, 325, 350, 375, 400, 425, 450, 475, 500 or more monomeric units (e.g., residues) as found in the whole polymer. In some embodiments, a polymer fragment comprises or consists of at least about 5%, 10%, 15%, 20%, 25%, 30%, 25%, 40%, 45%, 50%, 55%, 60%, 65%, 70%, 75%, 80%, 85%, 90%, 95%, 96%, 97%, 98%, 99% or more of the monomeric units (e.g., residues) found in the whole polymer. The whole material or entity may in some embodiments be referred to as the "parent" of the whole.

Human: In some embodiments, a human is an embryo, a fetus, an infant, a child, a teenager, an adult, or a senior citizen.

"Improve," "increase", "inhibit" or "reduce": As used herein, the terms "improve", "increase". "inhibit". "reduce", or grammatical equivalents thereof, indicate values that are relative to a baseline or other reference measurement. In some embodiments, an appropriate reference measurement may be or comprise a measurement in a particular system (e.g., in a single individual) under otherwise comparable conditions absent presence of (e.g., prior to and/or after) a particular agent or treatment, or in presence of an appropriate comparable reference agent. In some embodiments, an appropriate reference measurement may be or comprise a measurement in comparable system known or expected to respond in a particular way, in presence of the relevant agent or treatment.

In vitro: The term "in vitro" as used herein refers to events that occur in an artificial environment. e.g., in a test tube or reaction vessel, in cell culture, etc., rather than within a multi-cellular organism.

In vivo: as used herein refers to events that occur within a multi-cellular organism, such as a human and a non-human animal. In the context of cell-based systems, the term may be used to refer to events that occur within a living cell (as opposed to, for example, in vitro systems).

Library: The term "library" as used herein refers to a mixture of one or more distinct molecules. In some embodiments, all elements of a library share one or more common components. In some embodiments, all elements of a library share no common components. In some embodiments, one or more elements of a library are distinguished by one or more unique components. In some embodiments, as may be apparent from the context, a library may refer to a mixture of binding agents. In some embodiments, a library may be a phage library. In some embodiments, for example, a phage library may consist of phage with distinct binders displayed on (e.g. on a surface) of the phage and encapsulating DNA encoding for this binder within the phage. In some embodiments, a library may refer to a mixture of barcoded payload proteins. In some embodiments, a library may refer to a mixture of barcodes (e.g. peptide barcodes).

Linker: as used herein, is used to refer to that portion of a multi-element agent that connects different elements to one another. For example, those of ordinary skill in the art appreciate that a polypeptide whose structure includes two or more functional or organizational domains often includes a stretch of amino acids between such domains that links them to one another. In some embodiments, a polypeptide comprising a linker element has an overall structure of the general form S1-L-S2, wherein S1 and S2 may be the same or different and represent two domains associated with one another by the linker. In some embodiments, a polyptide linker is at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100 or more amino acids in length. In some embodiments, a linker is characterized in that it tends not to adopt a rigid three-dimensional structure, but rather provides flexibility to the polypeptide. A variety of different linker elements that can appropriately be used when engineering polypeptides (e.g., fusion polypeptides) known in the art (see e.g., Holliger, P., et al. (1993) Proc. Natl. Acad. Sci. USA 90:6444-6448: Poljak, R. J., et al. (1994) Structure 2: 1 121-1123).

Nucleic acid: As used herein, in its broadest sense, refers to any compound and/or substance that is or can be incorporated into an oligonucleotide chain. In some embodiments, a nucleic acid is a compound and/or substance that is or can be incorporated into an oligonucleotide chain via a phosphodiester linkage. As will be clear from context, in some embodiments, "nucleic acid" refers to an individual nucleic acid residue (e.g., a nucleotide and/or nucleoside); in some embodiments, "nucleic acid" refers to an oligonucleotide chain comprising individual nucleic acid residues. In some embodiments, a "nucleic acid" is or comprises RNA; in some embodiments, a "nucleic acid" is or comprises DNA. In some embodiments, a nucleic acid is, comprises, or consists of one or more natural nucleic acid residues. In some embodiments, a nucleic acid is, comprises, or consists of one or more nucleic acid analogs. In some embodiments, a nucleic acid analog differs from a nucleic acid in that it does not utilize a phosphodiester backbone. For example, in some embodiments, a nucleic acid is, comprises, or consists of one or more "peptide nucleic acids", which are known in the art and have peptide bonds instead of phosphodiester bonds in the backbone, are considered within the scope of the present invention. Alternatively or additionally, in some embodiments, a nucleic acid has one or more phosphorothioate and/or 5'-N-phosphoramidite linkages rather than phosphodiester bonds. In some embodiments, a nucleic acid is, comprises, or consists of one or more natural nucleosides (e.g., adenosine, thymidine, guanosine, cytidine, uridine, deoxyadenosine, deoxythymidine, deoxy guanosine, and deoxycytidine). In some embodiments, a nucleic acid is, comprises, or consists of one or more nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof). In some embodiments, a nucleic acid comprises one or more modified sugars (e.g., 2'-fluororibose, ribose, 2'-deoxyribose, arabinose, and hexose) as compared with those in natural nucleic acids. In some embodiments, a nucleic acid has a nucleotide sequence that encodes a functional gene product such as an RNA or protein. In some embodiments, a nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, a nucleic acid is partly or wholly single stranded; in some embodiments, a nucleic acid is partly or wholly double stranded. In some embodiments a nucleic acid has a nucleotide sequence comprising at least one element that encodes, or is the complement of a sequence that encodes, a polypeptide. In some embodiments, a nucleic acid has enzymatic activity.

Payload: As used herein, the term "payload" refers to a protein sequence, which may be associated to a peptide barcode through at least one covalent bond. In some embodiments, a payload is a protein that is to be detected in a pool of proteins. In some embodiments, a payload is an unmodified protein that is to be detected in a pool of proteins without attaching a peptide barcode. In some embodiments, a payload is a modified protein that is to be detected in a pool of proteins. In some embodiments, a payload may be associated with a barcode (e.g. peptide barcode). In some embodiments, a payload may not be associated with a barcode (e.g. peptide barcode).

Peptide: The term "peptide" as used herein refers to a polypeptide that is typically relatively short, for example having a length of less than about 100 amino acids, less than about 50 amino acids, less than about 40 amino acids less than about 30 amino acids, less than about 25 amino acids, less than about 20 amino acids, less than about 15 amino acids, or less than 10 amino acids.

Polypeptide. As used herein refers to any polymeric chain of residues (e.g., amino acids) that are typically linked by peptide bonds. In some embodiments, a polypeptide has an amino acid sequence that occurs in nature. In some embodiments, a polypeptide has an amino acid sequence that does not occur in nature. In some embodiments, a polypeptide has an amino acid sequence that is engineered in that it is designed and/or produced through action of the hand of man. In some embodiments, a polypeptide may comprise or consist of natural amino acids, non-natural amino acids, or both. In some embodiments, a polypeptide may comprise or consist of only natural amino acids or only non-natural amino acids. In some embodiments, a polypeptide may comprise D-amino acids, L-amino acids, or both. In some embodiments, a polypeptide may comprise only D-amino acids. In some embodiments, a polypeptide may comprise only L-amino acids. In some embodiments, a polypeptide may include one or more pendant groups or other modifications, e.g., modifying or attached to one or more amino acid side chains, at the polypeptide's N-terminus, at the polypeptide's C-terminus, or any combination thereof. In some embodiments, such pendant groups or modifications may be selected from the group consisting of acetylation, amidation, lipidation, methylation, pegylation, etc., including combinations thereof. In some embodiments, a polypeptide may be cyclic, and/or may comprise a cyclic portion. In some embodiments, a polypeptide is not cyclic and/or does not comprise any cyclic portion. In some embodiments, a polypeptide is linear. In some embodiments, a polypeptide may be or comprise a stapled polypeptide. In some embodiments, the term "polypeptide" may be appended to a name of a reference polypeptide, activity, or structure; in such instances it is used herein to refer to polypeptides that share the relevant activity or structure and thus can be considered to be members of the same class or family of polypeptides. For each such class, the present specification provides and/or those skilled in the art will be aware of exemplary polypeptides within the class whose amino acid sequences and/or functions are known; in some embodiments, such exemplary polypeptides are reference polypeptides for the polypeptide class or family. In some embodiments, a member of a polypeptide class or family shows significant sequence homology or identity with, shares a common sequence motif (e.g., a characteristic sequence element) with, and/or shares a common activity (in some embodiments at a comparable level or within a designated range) with a reference polypeptide of the class; in some embodiments with all polypeptides within the class). For example, in some embodiments, a member polypeptide shows an overall degree of sequence homology or identity with a reference polypeptide that is at least about 30-40%, and is often greater than about 50%, 60%, 70%, 80%, 90%, 91%, 92%, 93%, 94%, 95%, 96%, 97%, 98%, 99% or more and/or includes at least one region (e.g., a conserved region that may in some embodiments be or comprise a characteristic sequence element) that shows very high sequence identity, often greater than 90% or even 95%, 96%, 97%, 98%, or 99%. Such a conserved region usually encompasses at least 3-4 and often up to 20 or more amino acids; in some embodiments, a conserved region encompasses at least one stretch of at least 2, 3, 4, 5, 6, 7, 8, 9, 10, 11, 12, 13, 14, 15 or more contiguous amino acids. In some embodiments, a useful polypeptide may comprise or consist of a fragment of a parent polypeptide. In some embodiments, a useful polypeptide as may comprise or consist of a plurality of fragments, each of which is found in the same parent polypeptide in a different spatial arrangement relative to one another than is found in the polypeptide of interest (e.g., fragments that are directly linked in the parent may be spatially separated in the polypeptide of interest or vice versa, and/or fragments may be present in a different order in the polypeptide of interest than in the parent), so that the polypeptide of interest is a derivative of its parent polypeptide.

Protein: As used herein, the term "protein" refers to a polypeptide (i.e., a string of at least two amino acids linked to one another by peptide bonds). Proteins may include moieties other than amino acids (e.g., may be glycoproteins, proteoglycans, etc.) and/or may be otherwise processed or modified. Those of ordinary skill in the art will appreciate that a "protein" can be a complete polypeptide chain as produced by a cell (with or without a signal sequence), or can be a characteristic portion thereof. Those of ordinary skill will appreciate that a protein can sometimes include more than one polypeptide chain, for example linked by one or more disulfide bonds or associated by other means. Polypeptides may contain l-amino acids, d-amino acids, or both and may contain any of a variety of amino acid modifications or analogs known in the art. Useful modifications include, e.g., terminal acetylation, amidation, methylation, etc. In some embodiments, proteins may comprise natural amino acids, non-natural amino acids, synthetic amino acids, and combinations thereof. In some embodiments, proteins are antibodies, antibody fragments, biologically active portions thereof, and/or characteristic portions thereof.

Reference: As used herein describes a standard or control relative to which a comparison is performed. For example, in some embodiments, an agent, animal, individual, population, sample, sequence or value of interest is compared with a reference or control agent, animal, individual, population, sample, sequence or value. In some embodiments, a reference or control is tested and/or determined substantially simultaneously with the testing or determination of interest. In some embodiments, a reference or control is a historical reference or control, optionally embodied in a tangible medium. Typically, as would be understood by those skilled in the art, a reference or control is determined or characterized under comparable conditions or circumstances to those under assessment. Those skilled in the art will appreciate when sufficient similarities are present to justify reliance on and/or comparison to a particular possible reference or control.

Sample: As used herein, the term "sample" typically refers to an aliquot of material obtained or derived from a source of interest. In some embodiments, as would be appreciated from the context by a person of ordinary skill in the art, the term "sample" may be used interchangeably with terms like "mixture", or "complex mixture", or "complex sample". In some embodiments, a source of interest is a biological or environmental source. In some embodiments, a source of interest may be or comprise a cell or an organism, such as a microbe, a plant, or an animal (e.g., a human). In some embodiments, a source of interest is or comprises biological tissue or fluid. In some embodiments, a biological tissue or fluid may be or comprise cells, serum, extracellular matrix, CSF, and/or combinations or component(s) thereof. In some embodiments, a biological tissue or fluid may be or comprise amniotic fluid, aqueous humor, ascites, bile, bone marrow, blood, breast milk, cerebrospinal fluid, cerumen, chyle, chime, ejaculate, endolymph, exudate, feces, gastric acid, gastric juice, lymph, mucus, pericardial fluid, perilymph, peritoneal fluid, pleural fluid, pus, rheum, saliva, sebum, semen, serum, smegma, sputum, synovial fluid, sweat, tears, urine, vaginal secreations, vitreous humour, vomit, and/or combinations or component(s) thereof. In some embodiments, a biological fluid may be or comprise an intracellular fluid, an extracellular fluid, an intravascular fluid (blood plasma), an interstitial fluid, a lymphatic fluid, and/or a transcellular fluid. In some embodiments, a biological fluid may be or comprise a plant exudate. In some embodiments, a biological tissue or sample may be obtained, for example, by aspirate, biopsy (e.g., fine needle or tissue biopsy), swab (e.g., oral, nasal, skin, or vaginal swab), scraping, surgery, washing or lavage (e.g., brocheoalvealar, ductal, nasal, ocular, oral, uterine, vaginal, or other washing or lavage). In some embodiments, a biological sample is or comprises cells obtained from an individual. In some embodiments, a sample is a "primary sample" obtained directly from a source of interest by any appropriate means. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to one or more techniques such as amplification or reverse transcription of nucleic acid, isolation and/or purification of certain components, etc.

Specific: The term 'specific'*, when used herein with reference to an agent having an activity, is understood by those skilled in the art to mean that the agent discriminates between potential target entities or states. For example, in some embodiments, an agent is said to bind "specifically" to its target if it binds preferentially with that target in the presence of one or more competing alternative targets. In many embodiments, specific interaction is dependent upon the presence of a particular structural feature of the target entity (e.g., an epitope, a cleft, a binding site). It is to be understood that specificity need not be absolute. In some embodiments, specificity may be evaluated relative to that of the binding agent for one or more other potential target entities (e.g., competitors). In some embodiments, specificity is evaluated relative to that of a reference specific binding agent. In some embodiments specificity is evaluated relative to that of a reference non-specific binding agent. In some embodiments, the agent or entity does not detectably bind to the competing alternative target under conditions of binding to its target entity. In some embodiments, binding agent binds with higher on-rate, lower off-rate, increased affinity, decreased dissociation, and/or increased stability to its target entity as compared with the competing alternative target(s).

Subject: As used herein, the term "subject" refers to an organism, typically a mammal (e.g., a human, in some embodiments including prenatal human forms). In some embodiments, a subject is suffering from a relevant disease, disorder or condition. In some embodiments, a subject is susceptible to a disease, disorder, or condition. In some embodiments, a subject displays one or more symptoms or characteristics of a disease, disorder or condition. In some embodiments, a subject does not display any symptom or characteristic of a disease, disorder, or condition. In some embodiments, a subject is someone with one or more features characteristic of susceptibility to or risk of a disease, disorder, or condition. In some embodiments, a subject is a patient. In some embodiments, a subject is an individual to whom diagnosis and/or therapy is and/or has been administered.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Therapeutic agent: As used herein, the phrase "therapeutic agent" in general refers to any agent that elicits a desired pharmacological effect when administered to an organism. In some embodiments, an agent is considered to be a therapeutic agent if it demonstrates a statistically significant effect across an appropriate population. In some embodiments, the appropriate population may be a population of model organisms. In some embodiments, an appropriate population may be defined by various criteria, such as a certain age group, gender, genetic background, preexisting clinical conditions, etc. In some embodiments, a therapeutic agent is a substance that can be used to alleviate, ameliorate, relieve, inhibit, prevent, delay onset of, reduce severity of, and/or reduce incidence of one or more symptoms or features of a disease, disorder, and/or condition. In some embodiments, a "therapeutic agent" is an agent that has been or is required to be approved by a government agency before it can be marketed for administration to humans. In some embodiments, a "therapeutic agent" is an agent for which a medical prescription is required for administration to humans. In some embodiments, a therapeutic agent is a therapeutic protein.

DETAILED DESCRIPTION

I. Barcoded Payloads

Methods and systems to generate and use barcodes and barcoded payloads are described herein. In some embodiments, methods disclosed herein are used to detect and/or characterize payloads. In some embodiments, methods disclosed herein are used to detect and/or characterize proteins. In some embodiments, methods disclosed herein are used to detect and/or characterize therapeutic proteins. In some embodiments, methods disclosed herein are used to detect and/or characterize or non-therapeutic proteins. In some embodiments, methods disclosed herein are used to detect and/or characterize proteins by tagging them with barcodes (e.g. barcoded proteins). In some embodiments, methods disclosed herein are used to detect and/or characterize proteins in vitro. In some embodiments, methods disclosed herein are used to detect and/or characterize proteins in vivo. In some embodiments, methods disclosed herein are used to detect and/or characterize a protein. In some embodiments, methods disclosed herein are used to detect and/or characterize multiple (e.g. two or more, three or more, four or more, etc.) proteins.

Barcodes:

In some embodiments, a barcode is or comprises an amino acid sequence. In some embodiments, a barcode is or comprises an amino acid sequence that occurs in nature. In some embodiments, a barcode is or comprises an amino acid sequence that does not occur in nature. In some embodiments, a barcode is or comprises an amino acid sequence that is synthetic. In some embodiments, a barcode comprises naturally occurring amino acids. In some embodiments, a barcode comprises non-naturally occurring amino acids (e.g. modified amino acids). In some embodiments, a barcode is or comprises a peptide barcode.

Barcodes of the present disclosure can be of varying lengths. For example, in some embodiments, a barcode may have a length ranging between 1 and 100 amino acids. In some embodiments, a barcode may have a length ranging between 5 and 50 amino acids. In some embodiments, a barcode may have a length ranging between 8 and 25 amino acids. In some embodiments, a barcode may have a length ranging between 9 and 25 amino acids. In some embodiments, a barcode may have a length ranging between 9 and 15 amino acids. In some embodiments, a barcode may have a length of 1, 2, 3, 4, 5, 6, 7, 8, 9, 10, 11, 12, 13, 14, 15, 16, 17, 18, 19, 20, 21, 22, 23, 24, or 25 amino acids. In some embodiments, a barcode may have a length of at least 5 amino acids. In some embodiments, a barcode may have a length of at most 100 amino acids.

Barcodes, as described herein may be available in a library in different formats. For example, in some embodiments a barcode as described herein may be described as a nucleic acid sequence. In other instance, a barcode as described herein may be described as an amino acid sequence. A person of ordinary skill in the art will appreciate that barcodes described in one format may be converted to another format using basic biological principles. Accordingly, barcodes described as nucleic acid sequences may be translated in to proteins, which may be used to detect the presence or absence of a payload (e.g. protein) in a mixture. Such a translated barcode is referred to herein as a peptide barcode.

Accordingly, barcodes of the present disclosure when described using nucleic acids may have lengths different from amino acid sequence lengths disclosed in the paragraph above. For example, in some embodiments, a barcode may have a length ranging between 3 and 300 nucleotides. In some embodiments, a barcode may have a length ranging between 15 and 150 nucleotides. In some embodiments, a barcode may have a length ranging between 24 and 75 nucleotides. In some embodiments, a barcode may have a length ranging between 27 and 75 nucleotides. In some embodiments, a barcode may have a length ranging between 27 and 45 nucleotides. In some embodiments, a barcode may have a length of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, or 75 nucleotides. In some embodiments, a barcode may have a length of at least 15 nucleotides. In some embodiments, a barcode may have a length of at most 300 nucleotides.

Barcodes of the present disclosure may have one or more properties. In some embodiments, a barcode may be naturally occurring. In some embodiments, a barcode may not be naturally occurring (e.g. synthetic). In some embodiments, a barcode may have relatively no effect on payload function. For example, in some embodiments, tagging a payload (e.g. a protein) with a barcode as described herein does not alter or change relatively the function of the tagged payload. In some embodiments, a barcode may have an effect (e.g. positive or negative) on payload function. For example, in some embodiments, tagging a payload (e.g. a protein) with a barcode as described herein may alter or change relatively a function (e.g. half-life (e.g. longer half-life), enhance targeting to specific tissue, etc.) of the tagged payload. In some embodiments, a barcode may not illicit an immune response (e.g. an IgG response, a complement response, etc.). In some embodiments, barcodes are orthogonal to each other. In some embodiments, barcodes are not orthogonal to each other.

Barcodes of the present disclosure may be attached to various positions of a payload. For example, in some embodiments, a barcode may be attached to an optimal position on a payload. In some embodiments, a barcode may be attached to a non-optimal position on a payload. In some embodiments, a barcode may be attached to an optimal position on a protein. For example, in some embodiments, a barcode may be attached to an N-terminus of a protein. In some embodiments, a barcode may be attached to a C-terminus of a protein. In some embodiments, a barcode may be attached to a non-terminal position on a protein (e.g. side chain). In some embodiments, a barcode may be attached to a non-optimal position on a protein.

Among other things, barcodes (e.g. peptide barcodes or nucleic acids encoding peptide barcodes) of the present disclosure may be flanked by additional sequences (e.g. nucleic acid sequences, amino acid sequences, etc.). In some embodiments, a barcode may be flanked by additional sequences on a barcode's 5' end. In some embodiments, a barcode may be flanked by additional sequences on a barcode's 3' end. In some embodiments, a barcode may be flanked by additional sequences on a barcode's 3' and 5' end. In some embodiments, an additional sequence may be a primer binding site, a restriction endonuclease recognition sequence, a restriction enzyme site (e.g. a cleavage site), a sequence that encodes an amino acid sequence, a sequence that does not encode an amino acid sequence, an amino acid sequence, or a nucleic acid sequence. For example, in some embodiments, a barcode may be flanked by nucleic acid sequences encoding an amino acid sequence. In some embodiments, a barcode may be flanked by nucleic acid sequences that does not encode an amino acid sequence. In some embodiments, a barcode may be flanked by amino acid sequences. In some embodiments, a peptide barcode may be flanked by amino acid sequences (e.g. Glycine-Serine (GS)). Analogously, in some embodiments, a nucleic acid encoding a peptide barcode of the present disclosure may be flanked by additional sequences (e.g. nucleic acid sequences, amino acid sequences, etc.). In some embodiments, a nucleic acid encoding a peptide barcode may be flanked by nucleic acid sequences on a 5' end. In some embodiments, a nucleic acid encoding a peptide barcode may be flanked by nucleic acid sequences on a 3' end. In some embodiments, a nucleic acid encoding a peptide barcode may be flanked by nucleic acid sequences on a 3' and 5' end. In some embodiments, a nucleic acid encoding a peptide barcode may be flanked by nucleic acid sequences encoding an amino acid sequence comprising a Glycine—Serine (GS).

In some embodiments, a barcode may be flanked by restriction endonuclease recognition sequences. In some embodiments, a barcode may be flanked by restriction endonuclease recognition sequences on a barcode's 5' end. In some embodiments, a barcode may be flanked by restriction endonuclease recognition sequences on a barcode's 3' end. In some embodiments, barcode may be flanked by restriction endonuclease recognition sequences on a barcode's 3' and 5' end. In some embodiments, a nucleic acid encoding a peptide barcode may be flanked by restriction endonuclease recognition sequences. In some embodiments, a nucleic acid encoding a peptide barcode may be flanked by restriction endonuclease recognition sequences on a 5' end. In some embodiments, a nucleic acid encoding a peptide barcode may be flanked by restriction endonuclease recognition sequences on a 3' end. In some embodiments, a nucleic acid encoding a peptide barcode may be flanked by restriction endonuclease recognition sequences on a 3' and 5' end. In some embodiments, a restriction endonuclease recognition sequence may be recognized by one or more restriction enzymes (e.g. BsaI, BsmBI, BbsI, SapI, etc.). In some embodiments, restriction endonuclease recognition sequences are Type I, Type II, or Type Its restriction endonuclease recognition sequences. Such recognition sequences, for example, may be used to produce universal overhangs that may be used in cloning peptide barcodes into different locations of various payload. Such flexibility allows a barcode to be used to detect different protein payloads in different experiments.

In some embodiments, a nucleic acid sequence encoding a barcode (e.g. a peptide barcode) may be associated with (e.g. attached to, linked to) a second nucleic acid sequence encoding a payload (e.g. a protein payload of interest). Such nucleic acid sequences, for example, may be translated to form barcoded payloads (e.g. barcoded proteins). In some embodiments, a nucleic acid sequence encoding a barcode (e.g. a peptide barcode) is separate from a second nucleic acid sequence encoding a payload (e.g. a protein payload of interest). For such nucleic acid sequences, for example, a nucleic acid sequence encoding a barcode may be translated separately from a second nucleic acid sequence encoding a payload, and subsequently attached using one or more methods known in the art to join distinct amino acid sequences (e.g. using linkers).

Barcodes of the present disclosure may be associated (e.g. directly or indirectly attached) to payloads so as to form barcoded payloads. For example, in some embodiments, each barcode sequence (e.g. peptide barcode sequence) may be associated to only one payload of interest (e.g. protein of interest) within a mixture. In some embodiments, each barcode sequence may be associated to more than one payload of interest (e.g. payloads with different sequences) within a mixture. In some embodiments, multiple (e.g. two or more, three or more, four or more, etc.) barcode sequences may be associated to one payload of interest within a mixture. For example, in some embodiments, one or more barcode sequences may be associated to various different positions on a given payload—such a setup may be useful in, for example, in studying and identifying the stability and/or cleavage of such barcoded payloads. In some embodiments, each payload in a mixture is a unique sequence (e.g. each payload has a different sequence from every other payload in the mixture). In some embodiments, each payload in a mixture is a non-unique sequence.

Various methods and parameters may be used to select suitable barcodes for a given payload. For example, stability of a barcoded payload is key in determining if a payload may be tagged by said barcode. In some embodiments, a barcode may be tagged to a specific payload across different experiments. In some embodiments, a barcode may be tagged to different payloads in different experiments. For example, in some embodiments, a barcode may be tagged to two or more, three or more, four or more, ten or more, 100 or more, 1000 or more, or 10,000 or more different payloads across different experiments.

In some embodiments, a barcode may be associated with only one payload in a given experiment. In some embodiments, a barcode may be associated with multiple payloads in a given experiment. For example, in some embodiments, one or more barcodes are associated with multiple payloads (i.e. a barcode is tagged to multiple payloads) in a mixture, such that each payload is associated with a unique set of barcodes within the mixture. That is, each payload may be associated with a unique "pattern" of barcodes in the mixture. Analogously, in some embodiments, several payloads may be associated with the same barcode.

Among other things, barcodes described herein are designed to have a distinct (i.e. unique) sequence. In some embodiments, a barcode is designed to have a distinct sequence (e.g. distinct from another barcode). For example, each barcode is designed to be distinct (e.g. unique) from every other barcode used in an experiment, such that each payload (e.g. protein to be measured) is attached to at least one barcode, and each barcode (e.g. barcode with a specific sequence) is only attached to one payload. As may be understood by a person of ordinary skill in the art, the diversity of barcodes contained within a pool is limited only by the possible diversity of amino acid sequences for a given barcode length. For example, for a barcode length 'N', there exists $20^N$ distinct amino acid barcode sequences of length N (if only unmodified/naturally occurring amino acids are used). That is, for a barcode length of 15, the theoretical limit is $20^{15}$, or $3.2768 \times 10^{19}$.

Example of barcodes according to various embodiments of the present disclosure are listed in Tables 1 and 2. In some embodiments, a barcode (e.g. peptide barcode) is or comprises an amino acid sequence selected from SEQ ID NOs: 5347-8398. In some embodiments, a barcode (e.g. peptide barcode) is encoded by a sequence that is or comprises a nucleic acid sequence selected from SEQ ID NOs: 1148-4199.

Payload:

Methods and systems disclosed herein are may be used for detection of one or more payloads as described herein. In some embodiments, a payload is a protein of interest. In some embodiments, a payload is a protein that has a therapeutic function. In some embodiments, a payload is a protein that does not have a therapeutic function (e.g. may aid another payload with a therapeutic function). For example, possible payloads are proteins which one may wish to screen as drugs, such as monoclonal antibodies, single domain antibodies, enzymes, bispecific antibodies or any other protein which may have therapeutic function.

In one aspect, systems and methods disclosed herein may be used for detecting a payload (e.g. protein) in a mixture. Specifically, barcodes disclosed herein tagged to a payload (e.g. barcoded payload (e.g. barcoded protein)) in a mixture and used to detect said payload in the mixture. In some embodiments, each payload is different from every other payload in a mixture. In some embodiments, each payload in a mixture is different from every other payload in a mixture by at least one amino acid. In some embodiments, each payload in a mixture is different from every other payload in a mixture by two or more amino acids. In some embodiments, a payload (e.g. in a mixture) may be tagged with a barcode. In some embodiments, each payload (e.g. in a mixture) may be tagged with a same barcode. In some embodiments, each payload (e.g. in a mixture) may be tagged with different barcode. In some embodiments, a payload (e.g. in a mixture) may be tagged with a barcode that is different from every other barcode (e.g. associated with other payloads) in a mixture by at least one amino acid. In some embodiments, a payload (e.g. in a mixture) may be tagged with a barcode that is different from every other barcode (e.g. associated with other payloads) in a mixture by two or more amino acids.

As discussed elsewhere in the specification, a payload may be tagged with different barcodes (e.g. in different mixtures, different experiments, etc.). For example, as noted above, in some embodiments, each barcode sequence may be attached to only one payload of interest within a mixture. In some embodiments, each barcode sequence may be attached to more than one payload of interest (e.g. payloads with different sequences) within a mixture. In some embodiments, multiple (e.g. two or more, three or more, four or more, etc.) barcode sequences may be attached to one payload of interest within a mixture. For example, in some embodiments, one or more barcode sequences may be attached to various different positions on a given payload—such a setup may be useful in, for example, in studying and identifying the stability of such barcoded payloads. In some embodiments, each payload in a mixture is a unique sequence (e.g. each payload has a different sequence from every other payload in the mixture). In some embodiments, each payload in a mixture is a non-unique sequence.

In some embodiments, a payload may be tagged to a specific barcode across different experiments. In some embodiments, a payload may be tagged to different barcodes in different experiments. For example, in some embodiments, a payload may be tagged to two or more, three or more, four or more, ten or more, 100 or more, 1000 or more, or 10,000 or more different barcodes across different experiments.

In some embodiments, a payload may be associated with only one barcode in a given experiment. In some embodiments, a payload may be associated with multiple barcodes in a given experiment. For example, in some embodiments, one or more barcodes (e.g. in a mixture) are associated with multiple payloads (i.e. a barcode is tagged to multiple payloads) in a mixture, such that each payload is associated with a unique set of barcodes within the mixture. That is, each payload may be associated with a unique "pattern" of barcodes in the mixture. In some embodiments, several payloads may be associated with the same barcode.

Linkers:

Among other things, systems and methods described herein may use linkers. In some embodiments, a payload as described herein and a barcode as described herein are separated by a linker. In some embodiments, linkers (L) provide distance between a payload (P) and a barcode (b). That is, structurally a barcoded payload, in some embodiments, may have a sequence of P-L-b. This, for example, may contribute to folding characteristics, payload functionality, and/or payload stability.

In some embodiments, linkers may be nucleic acids. In some embodiments, linkers may be amino acids. Linkers as described herein may have varying lengths. For example, in some embodiments, a linker may have a length of at least 3 amino acids. In some embodiments, a linker may have a length of between 1 and 50 amino acids (e.g. between 1 and 30 amino acids).

In some embodiments, linkers of the present invention may be cleaved upon treatment. For example, in some embodiments, a linker may comprise one or more motifs that may be cleaved upon treatment.

In some embodiments, linkers of the present invention may be resistant to cleavage. In some embodiments, linkers of the present invention may be resistant to cleavage in assays. In some embodiments, linkers of the present invention may be resistant to cleavage in vivo.

In one aspect, linkers may be used to tag barcodes. In some embodiments, each linker sequence is associated with a distinct barcode sequence. For example, in some embodiments, a linker sequence may be used as a unique tag associated with a distinct barcode sequence (e.g. nucleic acid sequence) in a mixture. That is, in some embodiments, such a linker may be used to amplify an associated barcode sequence. For example, in some embodiments, such a linker may be used as a primer to amplify an associated barcode sequence. Subsequently, in some embodiments, an amplified linker may be used to isolate an associated barcode sequence, allowing for retrieval of the barcode sequence (e.g. nucleic acid sequence) from a given linker-barcode pair. In some embodiments, a linker-barcode pair may be subject to DNA sequencing for identification of the barcode sequence.

In some embodiments, a nucleic acid sequence encoding for a linker-barcode pair may be used to associate (e.g. link) the linker-barcode pair to a new payload.

II. Binders and Binding Agents

Binders:

In some embodiments, a binder (i.e. a binder moiety) is or comprises a nucleic acid sequence. In some embodiments, a binder is or comprises a nucleic acid sequence that occurs in nature. In some embodiments, a binder is or comprises a nucleic acid sequence that does not occur in nature. In some embodiments, a binder is or comprises a nucleic acid sequence that is synthetic. In some embodiments, a binder comprises naturally occurring nucleic acids. In some embodiments, a binder comprises non-naturally occurring nucleic acids (e.g. modified nucleic acids).

In some embodiments, a binder nucleic acid sequence is or comprises a sequence that encodes for a polypeptide sequence. For example, in some embodiments, a binder nucleic acid sequence may contain a region, which encodes for a polypeptide sequence conferring high affinity and/or specificity for a given barcode (e.g. peptide barcode). In some embodiments, a binder nucleic acid sequence is or comprises a sequence that encodes for an antibody. In some embodiments, a binder nucleic acid sequence is or comprises a sequence that encodes for a fragment of an antibody. In some embodiments, a binder nucleic acid sequence is or comprises a sequence that encodes for a single-chain variable Fragment (scFv). As may be known to those of ordinary skill in the art, a scFv is a fusion protein of the variable regions of the heavy (VH) and light chains (VL) of immunoglobulins. In some embodiments, a VH and VL chain may be connected with a short linker peptide (e.g. linker of about 5-50 amino acids in length, 10-25 amino acids in length, etc.).

In some embodiments, for example, a binder is generated to have known specificity and affinity for a given barcode. In some embodiments, a binder is generated to have known specificity and affinity for one barcode. In some embodiments, a binder is generated to have known specificity and affinity for multiple (e.g. two or more, three or more, etc.) barcodes. In some embodiments, a binder is generated to have known specificity and affinity for at least one barcode. In some embodiments, a binder, for example, is expressed on the surface of a binding agent (e.g. a phage, a ribosome, etc.) using methods known to those skilled in the art.

In some embodiments, a binder associates with a barcode (e.g. with known specificity and affinity).

In some embodiments, a binder is or comprises a polypeptide sequence that occurs in nature. In some embodiments, a binder is or comprises a polypeptide sequence that does not occur in nature. In some embodiments, a binder is or comprises a polypeptide sequence that is synthetic. In some embodiments, a binder comprises naturally occurring amino acids. In some embodiments, a binder comprises non-naturally occurring amino acids (e.g. modified amino acids).

Binders of the present invention may be of varying lengths. For example, in some embodiments, a binder may have a length ranging between 5 to 1000 amino acids. In some embodiments, a binder may have a length ranging between 5 to 800 amino acids. In some embodiments, a binder may have a length ranging between 6 to 500 amino acids. In some embodiments, a binder may have a length ranging between 10 to 400 amino acids. In some embodiments, a binder may have a length ranging between 5 to 500 amino acids. In some embodiments, a binder may have a length ranging between 5 to 1000 amino acids. In some embodiments, a binder may have a length of 10 amino acids. In some embodiments, a binder may have a length of at least 5 amino acids. In some embodiments, a binder may have a length of at most 1000 amino acids.

Binders, as described herein may be available in a library in different formats. For example, in some embodiments a binder as described herein may be described as a nucleic acid sequence. In other instance, a binder as described herein may be described as an amino acid sequence. A person of ordinary skill in the art will appreciate that binders described in one format may be converted to another format using basic biological principles. Accordingly, binders described as nucleic acid sequences may be translated in to proteins, which may be used to detect the presence or absence of a payload (e.g. barcoded payload (e.g. barcoded protein)) in a mixture. Such a translated binder is referred to herein as a polypeptide binder or polypeptide binder moiety.

Accordingly, binders of the present disclosure when described using nucleic acids may have lengths different from amino acid sequence lengths disclosed in the paragraph above. For example, in some embodiments, a binder may have a length ranging between 15 to 3000 nucleotides. In some embodiments, a binder may have a length ranging between 15 to 2400 nucleotides. In some embodiments, a binder may have a length ranging between 24 to 1500 nucleotides. In some embodiments, a binder may have a length ranging between 30 to 1200 nucleotides. In some embodiments, a binder may have a length of 30 nucleotides. In some embodiments, a binder may have a length of at least 15 nucleotides. In some embodiments, a binder may have a length of at most 3000 nucleotides.

Binders of the present disclosure may have one or more specific properties. In some embodiments, a binder may be naturally occurring. In some embodiments, a binder may not be naturally occurring (e.g. synthetic). In some embodiments, a binder may not illicit an immune response (e.g. an IgG response, a complement response, etc.).

Among other things, binders (e.g. polypeptide binders, nucleic acids encoding binders) of the present disclosure, like barcodes discussed above, may be flanked by additional sequences (e.g. nucleic acid sequences, amino acid sequences, etc.). In some embodiments, a binder may be flanked by additional sequences on a binder's 5' end. In some embodiments, a binder may be flanked by additional sequences on a binder's 3' end. In some embodiments, a binder may be flanked by additional sequences on a binder's 3' and 5' end. In some embodiments, an additional sequence may be a primer binding site, a restriction endonuclease recognition sequence, a restriction enzyme site (e.g. a cleavage site), a sequence that encodes an amino acid sequence, a sequence that does not encode an amino acid sequence, an amino acid sequence, or a nucleic acid sequence.

In one aspect of the present invention, a binder nucleic acid sequence may be associated with (e.g. attached to, linked to) another nucleic acid sequence. For example, in some embodiments, a binder nucleic acid sequence may be associated with a nucleic acid sequence encoding one or more genes. In some embodiments, a binder nucleic acid sequence may be associated with a nucleic acid sequence encoding one or more genes of a phage (e.g. m13). In some embodiments, a binder nucleic acid sequence may be associated with a nucleic acid sequence encoding a polypeptide. In some embodiments, a binder nucleic acid sequence may be associated with a nucleic acid sequence encoding a polypeptide of a phage (e.g. m13 gene3 protein). The binder-gene3 protein fusion can be expressed and incorporated into m13 phage.

Among other things, binders described herein are designed to have a distinct (i.e. unique) sequence. In some embodiments, a binder is designed to have a distinct sequence (e.g. distinct from another binder). For example, each binder is designed to be distinct (e.g. unique) from every other binder used in an experiment.

In one aspect of the present invention, binders bind to barcodes or barcoded payloads, as described herein, with high specificity and high affinity. In some embodiments, a barcode or barcoded payload (e.g. barcoded protein to be measured) binds to one binder, and each binder (e.g. binder with a specific sequence) binds to one barcode or barcoded payload. In some embodiments, a barcode or barcoded payload (e.g. barcoded protein to be measured) binds to at least one binder. In some embodiments, each binder (e.g. binder with a specific sequence) binds to at least one barcode or barcoded payload. In some embodiments, multiple binders (e.g. with different sequences (e.g. polypeptide sequences)) bind to a single barcode. In some embodiments, multiple barcodes (e.g. with different sequences (e.g. peptide sequences)) bind to a single binder.

Example of binders according to various embodiments of the present disclosure are listed in Tables 1 and 2. In some embodiments, a binder (e.g. polypeptide binder) is or comprises an amino acid sequence selected from SEQ ID NOs: 4200-5346. In some embodiments, a binder (e.g. polypeptide binder) is encoded by a sequence that is or comprises a nucleic acid sequence selected from SEQ ID NOs: 1-1147.

Binding Agents:

Methods described herein relate to the detection of one or more barcodes using a binding agent. In some embodiments, a binding agent is associated with or comprises a detectable nucleic acid. In some embodiments, a binding agent expresses a detectable nucleic acid. In some embodiments, a binding agent expresses a detectable nucleic acid on its surface (e.g. a binder). In some embodiments, a binding agent expresses an antibody on its surface.

In some embodiments, for example, to detect the presence of a specific (e.g. distinct) barcode, the present invention envisions the association of a distinct detectable nucleic acid (e.g. a DNA sequence, an RNA sequence, etc.) to a specific barcode. This is achieved through contacting a barcode with a binding agent. In some embodiments, one or more barcodes may be contacted with a binding agent. In some embodiments, one or more binding agents may be contacted with a barcode.

In some embodiments, a binding agent may be or comprises a phage, a ribosome, mRNA, DNA etc. In some embodiments, a binding agent is a phage. In some embodiments, a binding agent is may be a M13 phage, T4 phage, T7 phage, Lambda phage, or filamentous phage. In some embodiments, a binding agent is may be a M13 phage.

Binders as disclosed herein may be expressed on binding agents using methods known in the art. For example, a person of ordinary skill in the art may be able to express a nucleic acid encoding a polypeptide binder on (e.g. on a surface) of a phage using techniques and methods available in the art.

III. Production

Production of Barcodes:

Disclosed herein are methods and systems for the production of barcodes for use in systems and methods of the present disclosure. In some embodiments, barcodes, as described herein, may be generated rapidly (e.g. in about a week, about 2 weeks, about 3 weeks, about 4 weeks, about 1 month, about 2 months, about 3 months, about 4 months, about 5 months, about 6 months, or about 1 year). In some embodiments, for example, between about 100 to about 1,000 barcodes may be generated rapidly. In some embodiments, between about 10 to about 1000 barcodes may be generated rapidly. In some embodiments, between about 10 to about 10,000 barcodes may be generated rapidly. While large numbers of barcodes, as described herein, may be generated rapidly, such barcodes are also robust, in that barcodes generated using the methods disclosed herein may bind specifically and with different affinities to a known set of binders.

In accordance with various embodiments, barcodes as described herein may be synthesized using a nucleic acid (e.g. oligonucleotide) array. In some embodiments, barcodes as described herein may be synthesized using a DNA array. In some embodiments, nucleic acids (e.g. oligonucleotides) of a nucleic acid array are expressed in to barcodes. In some embodiments, barcodes as described herein may be synthesized using nucleic acid library. In some embodiments, a nucleic acid library is synthesized using a nucleic acid array. In some embodiments, nucleic acids (e.g. oligonucleotides) of a nucleic acid library are expressed in to barcodes.

In some embodiments, a barcode nucleic acid library comprises about 1 or more, about 2 or more, about 3 or more, about 4 or more, about 5 or more, about 10 or more, about 50 or more, about 100 or more, about 200 or more, about 300 or more, about 400 or more, about 500 or more, about 600 or more, about 700 or more, about 800 or more, about 900 or more, about 1000 or more, about 2000 or more, about 3000 or more, about 4000 or more, or about 5000 or more potential barcodes. In some embodiments, a nucleic acid library comprises one or more potential barcode sequences. Such potential barcode sequences may be screened for functionality as peptide barcodes (i.e. after translation of potential barcode nucleic acid sequences) using one or more methods described herein.

Barcodes of the present disclosure may be screened for one or more specific properties. In some embodiments, a barcode may be screened for specific binding (e.g. specificity, binding affinity) to a binder. In some embodiments, a barcode may be screened for specific binding to one or more binders. In some embodiments, a barcode may be screened for specific binding to at least a binder. In some embodiments, a barcode may be screened for specific binding to at most a binder. In some embodiments, a barcode may be screened for specific binding to multiple binders.

As may be understood by a person of ordinary skill in the art, a barcode is designed to be distinct (i.e. unique (e.g. have a unique sequence)) in a pool of barcodes. Such distinction may be achieved, in some embodiments, by changing one or more amino acids in a barcode. In some embodiments, a barcode is distinct from other barcodes in a pool of barcodes by 1 amino acid. In some embodiments, a barcode is distinct from other barcodes in a pool of barcodes by at least 1 amino acid. In some embodiments, a barcode is distinct from other barcodes in a pool of barcodes by at most 1 amino acid. In some embodiments, a barcode is distinct from other barcodes in a pool of barcodes by 2, 3, 4, 5, 6, 7, 8, 9, 10, 11, 12, 13, 14, 15, 16, 17, 18, 19, 20, 21, 22, 23, 24, or 25 amino acids. In some embodiments, a barcode is distinct from other barcodes in a pool of barcodes by at least 2 amino acids. In some embodiments, a barcode is distinct from other barcodes in a pool of barcodes by at most 50 amino acids.

Production of Barcoded Payloads:

Barcoded payloads in accordance with the present invention may be produced in various ways. In some embodiments, payload-barcode nucleic acid sequence pairs may be inserted into a plasmid to allow for expression in different expression systems (e.g. protein expression systems). In some embodiments, at least one payload-barcode nucleic acid sequence pair is inserted into a plasmid. In some embodiments, at least two payload-barcode nucleic acid sequence pairs are inserted into a plasmid. In some embodiments, at least three payload-barcode nucleic acid sequence pairs are inserted into a plasmid. In some embodiments, one or more payload-barcode nucleic acid sequence pairs are inserted into a plasmid.

In some embodiments, a payload-barcode nucleic acid sequence may comprise additional sequences. In some embodiments, a payload-barcode nucleic acid sequence may comprise additional nucleic acid sequences. In some embodiments, a payload-barcode nucleic acid sequence may comprise a universal motif sequence. In some embodiments, a payload-barcode nucleic acid sequence may comprise at least one universal motif sequence. In some embodiments, a payload-barcode nucleic acid sequence may comprise at least two universal motif sequences. In some embodiments, a payload-barcode nucleic acid sequence may comprise two or more universal motif sequences.

In some embodiments, at least one payload-barcode nucleic acid sequences in a pool of payload-barcode nucleic acid sequences may comprise a universal motif sequence. In some embodiments, all payload-barcode nucleic acid sequences in a pool of payload-barcode nucleic acid sequences may comprise a universal motif sequence.

Different plasmids may be used to produce technologies described herein. In some embodiments, a plasmid is a DNA plasmid. In some embodiments, a plasmid is an RNA plasmid. In some embodiments, a plasmid is a fertility F-plasmid. In some embodiments, a plasmid is a resistance plasmid. In some embodiments, a plasmid is a virulence plasmid. In some embodiments, a plasmid is a degradative plasmid. In some embodiments, a plasmid is a Col plasmid.

Different hosts (e.g. host cell, host cell line, etc.) may be used to produce technologies described herein. In some embodiments, a host is a mammalian host. In some embodiments, a host is a non-mammalian host. In some embodiments, a host is an insect. In some embodiments, a host is a bacteria. In some embodiments, a host is *E. coli*.

In some embodiments, a payload-barcode pair is expressed in vitro. In some embodiments, a payload-barcode pair is expressed in vivo. In some embodiments, a payload-barcode pair is expressed from RNA. In some embodiments, a payload-barcode pair is expressed from transcribed RNA. In some embodiments, a payload-barcode pair is expressed from DNA. In some embodiments, a payload-barcode pair is expressed using protein components (e.g. required for protein translation).

After expression of barcoded payload constructs, the constructs may be purified from the pool. In some embodiments, purification may be performed using a universal motif. In some embodiments, purification may be performed using HIS tag, FLAG tag, HALO tag, SNAP tag, Avitag. Twin strep tag, or any other tag based method of protein purification known in the art.

Production of Binders:

Disclosed herein are methods and systems for the production of binders for use in systems and methods of the present disclosure. In some embodiments, binders, as described herein, may be generated rapidly (e.g. in about a week, about 2 weeks, about 3 weeks, about 4 weeks, about 1 month, about 2 months, about 3 months, about 4 months, about 5 months, about 6 months, or about 1 year). In some embodiments, for example, between about 100 to about 1000 binders may be generated rapidly. In some embodiments, between about 10 to about 1000 binders may be generated rapidly. In some embodiments, between about 10 to about 10,000 binders may be generated rapidly. While large numbers of binders, as described herein, may be generated rapidly, such binders are also robust, in that binders generated using the methods disclosed herein may bind specifically and with different affinities to a known set of barcodes.

In some embodiments, a binder nucleic acid library comprises about 1 or more, about 2 or more, about 3 or more, about 4 or more, about 5 or more, about 10 or more, about 50 or more, about 100 or more, about 200 or more, about 300 or more, about 400 or more, about 500 or more, about 600 or more, about 700 or more, about 800 or more, about 900 or more, about 1000 or more, about 2000 or more, about 3000 or more, about 4000 or more, or about 5000 or more potential binders. In some embodiments, a nucleic acid library comprises one or more potential binder sequences. Such potential binder sequences may be screened for functionality as polypeptide binders (i.e. after translation of potential nucleic acid binder sequences) using one or more methods described herein.

Binders in accordance with the present invention may be produced in various ways. In some embodiments, a binder nucleic acid sequence may be inserted into a plasmid to allow for expression in different expression systems. In some embodiments, at least one binder nucleic acid sequence is inserted into a plasmid. In some embodiments, at least two binder nucleic acid sequences are inserted into a plasmid. In some embodiments, at least three binder nucleic acid sequences are inserted into a plasmid. In some embodiments, one or more binder nucleic acid sequences are inserted into a plasmid.

In some embodiments, a binder nucleic acid sequence is attached to one or more genes. In some embodiments, a binder nucleic acid sequence is attached to one or more genes prior to insertion in to a plasmid. In some embodiments, a binder nucleic acid sequence is attached to one or more genes after insertion in to a plasmid. In some embodiments, a binder nucleic acid sequence is attached to a bacteriophage gene. In some embodiments, a binder nucleic acid sequence is attached to an m13 bacteriophage gene. In some embodiments, a binder nucleic acid sequence is attached to gene 3 (i.e. that encodes for gene 3 protein) of m13 bacteriophage.

In some embodiments, plasmids (e.g. containing binder sequences, containing binder and bacteriophage sequences, etc.) may be transformed in to a host. In some embodiments, plasmids may be transformed in to a host and expressed. In some embodiments, plasmids are transformed in to a bacterium. In some embodiments, plasmids are transformed in to *E. coli*.

In some embodiments, expression of plasmids results in phage production. In some embodiments, expression of plasmids results in display of a binder on a surface of a phage. In some embodiments, expression of plasmids results in display of two binders on a surface of a phage. In some embodiments, expression of plasmids results in display of at least one binder on a surface of a phage. In some embodiments, expression of plasmids results in display of one or more binders on a surface of a phage. In some embodiments, expression of plasmids results in display of one or more binders on one or more surfaces of a phage. In some embodiments, expression of plasmids results in display of at least one binder on one or more surfaces of a phage.

Following phage production, the resulting pool may be purified to determine the presence of one or more polypeptide binders. In some embodiments, purification may be performed using a universal motif. In some embodiments, purification may be performed using HIS tag, FLAG tag, HALO tag, SNAP tag, Avitag, Twin strep tag, or any other tag based method of protein purification known in the art.

In some embodiments, a purified binder pool may be highly diverse. In some embodiments, a purified binder pool may not be highly diverse. In some embodiments, a purified binder pool is subjected to screening methods to select binders of interest.

Binders of the present disclosure may be screened for one or more specific properties. In some embodiments, a binder may be screened for specific binding to a barcode. In some embodiments, a binder may be screened for specific binding to one or more barcodes. In some embodiments, a binder may be screened for specific binding to at least a barcode. In some embodiments, a binder may be screened for specific binding to at most a barcode. In some embodiments, a binder may be screened for specific binding to multiple barcodes.

As may be understood by a person of ordinary skill in the art, a binder is designed to be distinct (i.e. unique (e.g. have a unique sequence)) in a pool of binders. Such distinction may be achieved, in some embodiments, by changing one or more amino acids in a binder. In some embodiments, a binder is distinct from other binders in a pool of binders by 1 amino acid. In some embodiments, a binder is distinct from other binder in a pool of binders by at least 1 amino acid. In some embodiments, a binder is distinct from other binder in a pool of binders by at most 1 amino acid. In some embodiments, a binder is distinct from other binder in a pool of binders by 2, 3, 4, 5, 6, 7, 8, 9, 10, 0.1, 12, 13, 14, 15, 16, 17, 18, 19, 20, 21, 22, 23, 24, or 25 amino acids. In some embodiments, a binder is distinct from other binder in a pool of binders by at least 2 amino acids. In some embodiments, a binder is distinct from other binder in a pool of binders by at most 1000 amino acids.

IV. Characterization

Samples:

As described elsewhere in the present disclosure, a sample may be a biological sample. In some embodiments, a sample may contain one or more barcoded payloads. In some embodiments, a sample may contain one or more barcoded proteins.

In some embodiments, a sample is derived from an organism. In some embodiments, a sample is derived from an animal. In some embodiments, a sample is derived from an animal model of disease. In some embodiments, a sample is derived from a non-mammal. In some embodiments, a sample is derived from a mammal (e.g., a rodent, a mouse, a rat, a rabbit, a monkey, a dog, a cat, a sheep, cattle, a primate, and/or a pig). In some embodiments, a sample is derived from a mouse. In some embodiments, a sample is derived from a human. In some embodiments, a sample is derived from cells (e.g. in vitro). In some embodiments, a sample is a human cell line.

In some embodiments, a sample may be purified. In some embodiments, a sample may not be purified.

In some embodiments, a sample is obtained from cells that was treated with barcoded payloads. In some embodiments, a sample is obtained from cells that was not treated with barcoded payloads. In some embodiments, a sample is obtained from an animal that was treated with barcoded payloads. In some embodiments, a sample is obtained from an animal that was not treated with barcoded payloads. For example, in some embodiments, a sample is obtained from a human that was treated with barcoded proteins.

In some embodiments, a sample is obtained from cells that was genetically modified. In some embodiments, a sample is obtained from cells that was modified by gene therapy. In some embodiments, a sample is obtained from cells that was genetically modified to include one or more barcoded payloads. In some embodiments, a sample is obtained from cells that was genetically modified to express a barcoded payloads. In some embodiments, a sample is obtained from cells that was genetically modified to include one or more barcodes. In some embodiments, a sample is obtained from cells that was genetically modified to express a barcodes. In some embodiments, a sample is obtained from cells that was genetically modified to include one or more binders. In some embodiments, a sample is obtained from cells that was genetically modified to express a binders.

In some embodiments, a sample is obtained from an animal that was genetically modified. In some embodiments, a sample is obtained from an animal that was modified by gene therapy. In some embodiments, a sample is obtained from an animal that was genetically modified to include one or more barcoded payloads. In some embodiments, a sample is obtained from an animal that was genetically modified to express a barcoded payloads. In some embodiments, a sample is obtained from an animal that was genetically modified to include one or more barcodes. In some embodiments, a sample is obtained from an animal that was genetically modified to express a barcodes. In some embodiments, a sample is obtained from an animal that was genetically modified to include one or more binders. In some embodiments, a sample is obtained from an animal that was genetically modified to express a binders.

Fingerprints:

Among other things, systems and methods described herein identify the advantages of nucleic acid sequencing techniques and apply them effectively to protein detection and measurement methods. For example, methods described herein may use several binders, with known binding specificities and affinities to different barcodes, that can be expressed on binding agents and mixed together in a single pool. Upon mixing with a pool of barcoded proteins (i.e. proteins, each associated with a barcode as described herein), each binder expressed on a binding agent binds to a one or more barcodes in the pool with known but varying affinities. Such a spectrum of affinities for a given barcode to one or more binders results in a distinct distribution of binder counts for a given barcode that can be determined through NGS, and is termed herein a 'Barcode Fingerprint'. In some embodiments, the collective barcode fingerprints for a set of barcodes is termed herein a 'Fingerprint Matrix'. Analogously, a spectrum of affinities of a binder to various (e.g. one or more) barcodes is termed herein as a 'Binder Fingerprint'. In some embodiments, using the provided technologies the presence of a barcoded protein(s) can be detected, for example, in a complex solution, by extracting and sequencing the associated nucleic acid (e.g. detectable nucleic acid (e.g. DNA sequence, RNA sequence, etc.)) of the population of binding agents (e.g. phage) that bind to the barcoded protein(s). That is, for example, in some embodiments, the presence of a protein in a complex solution is determined not through a single binder, but through a specific combination of multiple binders that bind to a barcode associated with said protein in fixed, known proportions.

Fingerprints, as disclosed herein, have many advantages. In some embodiments, a fingerprint approach of detection allows for reduction of noise. For example, the use of multiple binders to detect a barcode in a complex solution introduces a redundancy into the detection methods that in turn reduces signal noise. Additionally, another advantage of the "fingerprint" approach is that partial non-specificities in the binders (e.g. to barcodes other than the barcode of interest to be detected) can be tolerated and compensated for by the computational prediction methods.

In some embodiments, binder sequences may be modified in order to change a fingerprint. In some embodiments, binder sequences may be modified in order to improve a fingerprint.

A barcode fingerprint, as described herein, for a given barcode may include affinity information of a given barcode to one or more binders. In some embodiments, a barcode fingerprint may include affinity information of a given barcode to one binder. In some embodiments, a barcode fingerprint may include affinity information of a given barcode to at least one binder. In some embodiments, a barcode fingerprint may include affinity information of a given barcode to 2, 3, 4, 5, 10, 20, 25, 50, 100, 200, 300, 400, 500, 600, 700, 800, 900, 1000, 2000, 3000, 4000, 5000, 6000, 7000, 8000, 9000, or 10,000 or more binders. In some embodiments, a barcode fingerprint may include affinity information of a given barcode to at most 10,000 binders.

A binder fingerprint, as described herein, for a given binder may include affinity information of a given binder to one or more barcodes. In some embodiments, a binder fingerprint may include affinity information of a given binder to one barcode. In some embodiments, a binder fingerprint may include affinity information of a given binder to at least one barcode. In some embodiments, a binder fingerprint may include affinity information of a given binder to 2, 3, 4, 5, 10, 20, 25, 50, 100, 200, 300, 400, 500, 600, 700, 800, 900, 1000, 2000, 3000, 4000, 5000, 6000, 7000, 8000, 9000, or 10,000 or more barcodes. In some embodiments, a binder fingerprint may include affinity information of a given binder to at most 10,000 barcodes.

As discussed herein, in some embodiments, multiple barcode fingerprints for a set of barcodes may be grouped together and is termed herein a 'Fingerprint Matrix'. In some embodiments, a fingerprint matrix may comprise one barcode fingerprint. In some embodiments, a fingerprint matrix may comprise at least one barcode fingerprint. In some embodiments, a fingerprint matrix may comprise 2, 3, 4, 5, 10, 20, 25, 50, 100, 200, 300, 400, 500, 600, 700, 800, 900, 1000, 2000, 3000, 4000, 5000, 6000, 7000, 8000, 9000, or 10,000 or more barcode fingerprints. In some embodiments, a fingerprint matrix may comprise at most 10,000 barcode fingerprints.

The technologies described herein allow for the generation and characterization of unique fingerprints for each barcode. This allows, for example, availability of methods of payload (i.e. target (e.g. protein)) detection that may not require orthogonality between barcode-binder pairs. In some embodiments, barcode-binder pairs may be orthogonal. In some embodiments, barcode-binder pairs may not be orthogonal. As may be evident to a person of ordinary skill in the art, barcode-binder pairs as described herein provide the advantage of being more robust, as the availability of unique fingerprints makes non-specific binding less of a concern, a major advantage in complex environments (e.g. serum, blood, etc.).

Decoding:

Analysis

A key component of the invention is the method used to deduce relative or absolute protein concentrations from the DNA sequencing of binders. In the invention, the DNA sequences are translated in silico into amino acid sequences corresponding to each binder and tabulated to yield a table of binder counts. The binder count table measured for any given barcode in isolation is henceforth known as a "fingerprint" of a barcode. When applying the invention to an unknown mixture of barcoded payloads, the relative or absolute abundance of individual barcodes is determined by comparing the binder count table to the predetermined fingerprints of the individual barcodes and applying a computational prediction method described below. In some embodiments, the binder count table of a mixture of m unknown barcodes is assumed to be a linear combination of their respective fingerprints; the coefficients of the linear combination are inferred through least-squares fitting of the equation $Ax=b$, where A is an n-by-m matrix of fingerprints, b is a length-n vector of binder counts, and x is an undetermined length-m vector of the abundances of each of the barcodes. In some embodiments, the abundances of each of the barcodes is inferred using a Bayesian method, whereby a suitable prior probability distribution over the barcode abundances is assumed, a likelihood ratio of the observed count table given barcode abundances is calculated from a model of the uncertainties in the experimental system, and a posterior probability distribution is inferred the product of the prior with the likelihood ratio. In some embodiments, the posterior distribution is estimated using Monte Carlo sampling methods. In some embodiments, the maximum of the posterior distribution is determined with a computational optimization procedure. In some embodiments, the binder count table is assumed to be a non-linear function of the abundances of various barcodes to account for saturation of particular barcode-binder interactions or competition between distinct barcodes or distinct binders.

In some embodiments, relative proportions of binder counts are compared directly in order to determine relative proportions of barcodes. In some embodiments, sequences of known abundance are mixed into the experiment, and utilized to determine the absolute abundance of a given binder, which is used to estimate an absolute concentration for a barcode.

V. Use

Assessing Payloads:

Technologies described herein may be used to detect, assess, and/or characterize payloads (e.g. proteins). In some embodiments, provided technologies may be used, for example, to assay payloads in complex environments (e.g. serum, blood, tissue, etc.). In some embodiments, payloads may be proteins. In some embodiments, payloads may be therapeutic proteins.

As described herein, a payload may be associated with a barcode (i.e. a barcoded payload). In some embodiments, a barcoded payload may be assayed using binding agents (e.g. phages with binders expressed on them) using methods as described herein. In some embodiments, a barcoded payload may be captured (e.g. using affinity reagents) on a surface (e.g. beads or plates). In some embodiments, a barcoded payload may be immobilized for barcode assaying. In some embodiments, a barcoded payload is contacted with one or more binders and subject to decoding as described herein.

In some embodiments, payloads may be detected, assessed, and/or characterized in vitro. In some embodiments, payloads may be detected, assessed, and/or characterized in vivo.

Kits:

Technologies as described herein may be provided in the form a composition. For example, in some embodiments, a composition may comprise one or more elements (e.g. nucleic acid, amino acid, etc.) to produce or generate one or more barcodes and/or binders as described herein. In some embodiments, a composition may comprise one or more elements to produce or generate a set of barcodes. In some embodiments, a composition may comprise one or more elements to produce or generate a set of binders. In some embodiments, a composition may comprise one or more elements to produce or generate a pool of barcode-binder pairs. In some embodiments, a composition may comprise one or more elements to produce or generate binding agents (e.g. phage expressing binders). In some embodiments, a composition may be a barcode composition. In some embodiments, a composition may be a binder composition. In some embodiments, a composition may be a barcode-binder composition. In some embodiments, a composition may be a binding agent composition. In some embodiments, a composition may comprise one or more of barcodes, binders, binding agents, and/or components thereof. In some embodiments, a composition may comprise one or more sets/pools of barcodes, binders, binding agents, and/or components thereof.

Provided herein are compositions comprising barcodes, binders, binding agents, or components thereof. In some embodiments, a composition comprises barcodes, binders, binding agents, components thereof and/or combinations thereof, which have been assessed, identified, characterized or assayed using methods as described herein. In some embodiments, a composition provided herein comprises one or more, two or more, three or more, four or more, five or more, six or more, seven or more, eight or more, nine or more, or ten or more barcodes, binders, binding agents, components thereof and/or combinations thereof, which have been assessed, identified, characterized or assayed using methods as described herein.

In some embodiments, a composition provided herein comprises two or more, three or more, four or more, five or more, six or more, seven or more, eight or more, nine or more, or ten or more nucleic acid sequences or amino acid sequences as listed in Tables 1 or 2.

A composition as described herein may be formulated in various forms. For example, in some embodiments, a composition as described herein may be formulated in a powder form (e.g. lyophilized). In some embodiments, a composition as described herein may be formulated in a liquid form.

In some embodiments, compositions for use in accordance with the present disclosure are pharmaceutical compositions, e.g., for administration (e.g., topical, oral, subcutaneous, intravenous, intramuscular, intracerebral, intrathecal, rectal (e.g. rectal intubation), opthalmical, intravitreal, or suprachoroidal administration) to a subject (e.g. a mammal (e.g., a human)). In some embodiments, such compositions are administered to a subject to detect, characterize, and/or assess one or more attributes of one or more payloads administered or to be administered to the subject. Pharmaceutical compositions typically include an agent to be administered (e.g., barcodes, binders, binding agents, and/or components thereof), and a pharmaceutically acceptable carrier. Certain exemplary pharmaceutically acceptable carriers include, for instance saline, solvents, dispersion media, coatings, antibacterial and antifungal agents, isotonic and absorption delaying agents, and the like, compatible with pharmaceutical administration. Pharmaceutical compositions are typically formulated to be compatible with its intended route of administration. Examples of routes of administration include topical, oral, subcutaneous, intravenous, intramuscular, intracerebral, intrathecal, rectal, (e.g. rectal intubation), opthalmical, intravitreal, or suprachoroidal administration.

In some embodiments, pharmaceutically compatible binding agents, and/or adjuvant materials can be included as part of a pharmaceutical composition. In some particular embodiments, a pharmaceutical composition can contain, e.g., any one or more of the following inactive ingredients, or compounds of a similar nature: a binder, an excipient, a lubricant, a glidant, or some similar such compound.

Compositions can be included in a kit, container, pack, or dispenser, together with instructions for administration (e.g. to a subject) or for use in a method described herein. In some embodiments, instructions may include methods to reconstitute a powder form composition to a liquid form composition for further use. In some embodiments, a kit may include instructions that allows a user to generate new set of binders for a new set of barcodes. In some embodiments, a kit comprises a set of instructions to perform sequencing of one or more phage particles bound to one or more barcodes.

In some embodiments, a kit comprises information designating peptide barcodes for each binder. In some embodiments, a kit comprises a computer readable program for decoding sequencing data.

In some embodiments, a kit comprises reagents to express a binder on a phage particle. In some embodiments, a kit comprises nucleic acids that encode one or more barcodes. In some embodiments, a kit comprises nucleic acids that encode one or more binders.

Those skilled in the art, reading the present disclosure, will appreciate that, in some embodiments, a composition (e.g., a binder composition, a barcode composition, a binding agent composition, etc.) as described herein may be or comprise one or more cells, tissues, or organisms (e.g., plant or microbe cells, tissues, virus, or organisms) that produce (e.g., have produced, and/or are producing) a relevant binder, barcode, and/or binding agent as described herein.

Those skilled in the art will appreciate that, in some embodiments, technologies for preparing compositions and/or preparations, and/or for preparing (and particularly for preparing pharmaceutical compositions) may include one or more steps of assessing or characterizing a compound, preparation, or composition, e.g., as part of quality control. In some embodiments, if an assayed material does not meet pre-determined specifications for the relevant assessment, it is discarded. In some embodiments, if such assayed material does meet the pre-determined specifications, then it continues to be processed as described herein.

In some embodiments, a composition is tailored to a specific subject (e.g. a specific mammal, e.g. a patient). In some embodiments, a composition is specific for a payload to be assessed for an individual subject (e.g., mammal (e.g. human, mouse, etc.)). In some embodiments, a composition is specific for payloads to be assessed for an individual subject (e.g., mammal (e.g. human, mouse)). In some embodiments, a composition is specific for payloads of a population of subjects (e.g. mammals (e.g., humans, mice, etc.)). Populations of subjects can include, but are not limited to, families, subjects in the same regional location (e.g., neighborhood, city, state, or country), subjects with the same disease or condition, subjects of a particular age or age range, subjects that consume a particular diet (e.g., food, food source, or caloric intake).

EXEMPLIFICATION

Example 1: Identification of Barcodes, Corresponding Binding Agents, and Determining Fingerprints The present Example demonstrates methods for identifying barcodes, corresponding binding agents (e.g. binders expressed on binding agents), and determining fingerprints (e.g. barcode fingerprints) and using the information to determine the proportion of a barcode in a given mixture. The resulting materials can then be used to measure and quantify different payloads.

Design and Synthesis of a Barcode Library:

Barcode sequences were designed which contain specific sequence motifs thought to fold into a given helical or loop structure. All sequences from the Protein Data Bank (PDB) were downloaded, along with their corresponding secondary structure predictions. Sequences were selected and subsetted from the full sequence if they met the criteria of: being a contiguous helix or loop sequence for a length of 8-25 amino acids. A random subset of 100,000 of the peptide sequences matching this criteria were then ordered as an oligo pool, containing constant overhangs and type IIS sites for cloning into a vector (see FIG. 1B).

Figure 1A:
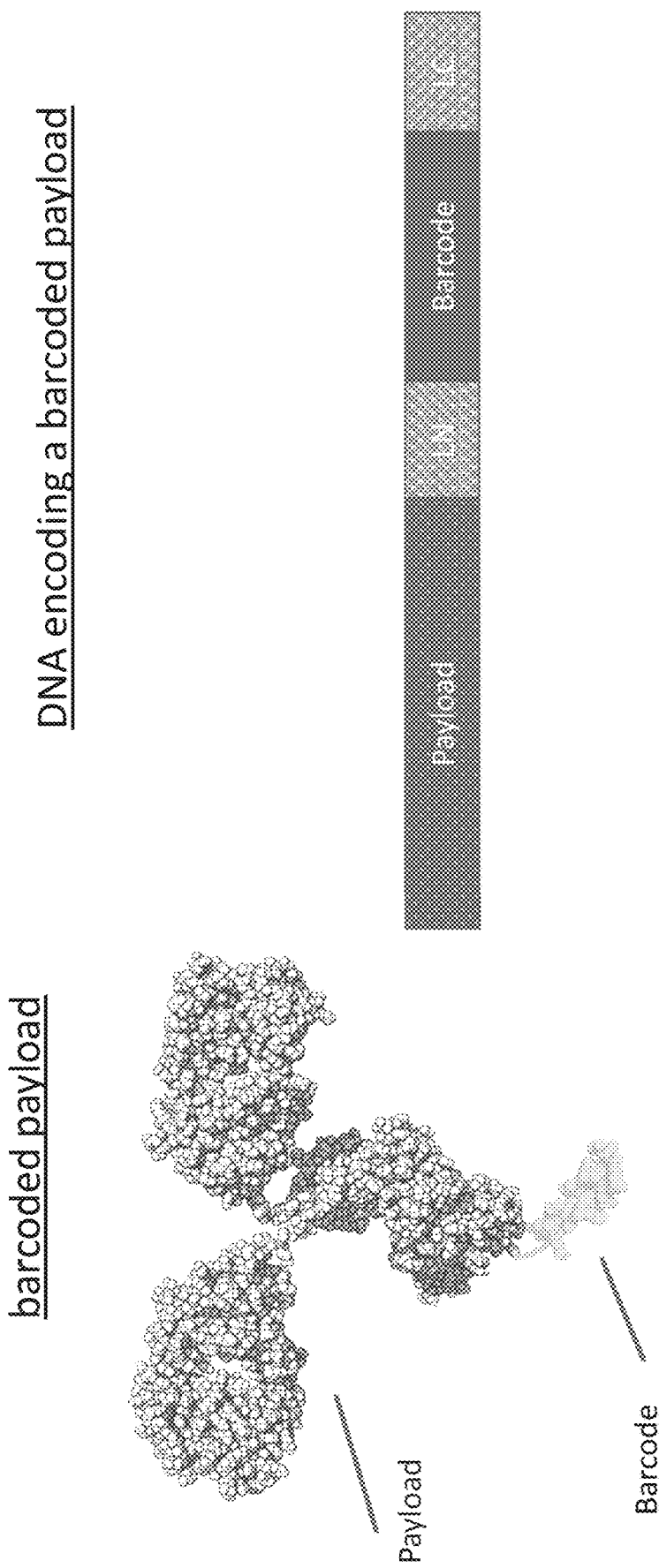
FIG. 1A is a schematic of barcoded payload as described herein, according to an illustrative embodiment. It illustrates a barcoded payload and the corresponding DNA encoding a barcoded payload. LN refers to "linker N terminus" and LC refers to "linker C terminus". In some embodiments, LN and LC sequences are constant and encode amino acids that connect the payload to the barcode. In some embodiments, LN and LC sequences are constant and are nucleic acid sequences used for modular cloning of barcodes with different payloads. In some embodiments, LN and LC sequences are flanked by Type IIS restriction site sequences.
Figure 1B:
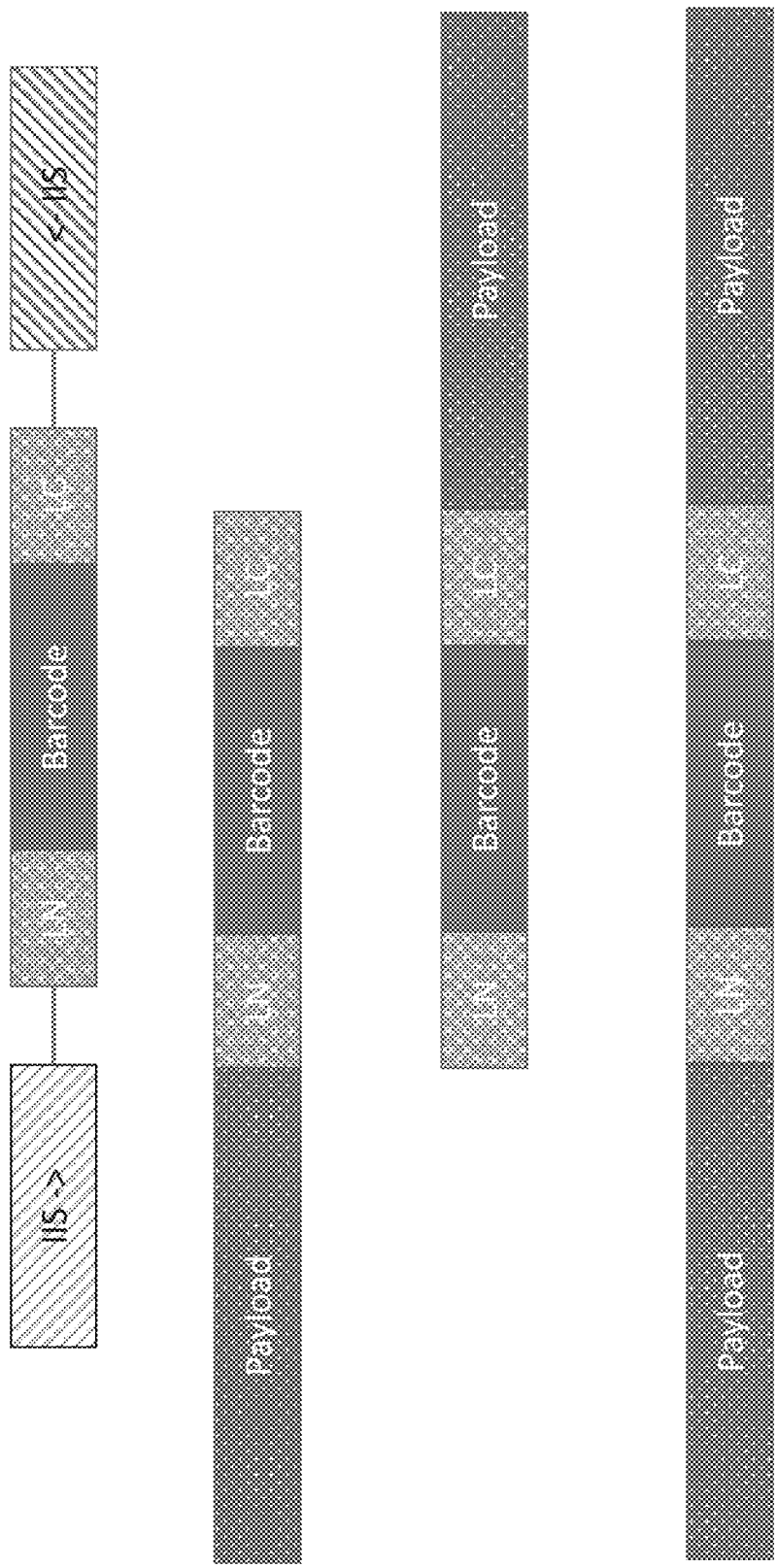
FIG. 1B is a schematic of barcoded payload as described herein, according to an illustrative embodiment. It illustrates a nucleic acid sequence encoding a barcode and/or a barcoded payload. LN refers to "linker N terminus" and LC refers to "linker C terminus". In some embodiments, LN and LC sequences are constant and encode amino acids that connect the payload to the barcode. In some embodiments, LN and LC sequences are constant and are nucleic acid sequences used for modular cloning of barcodes with different payloads. In some embodiments, LN and LC sequences are flanked by Type IIS restriction site sequences.
Figure 2:
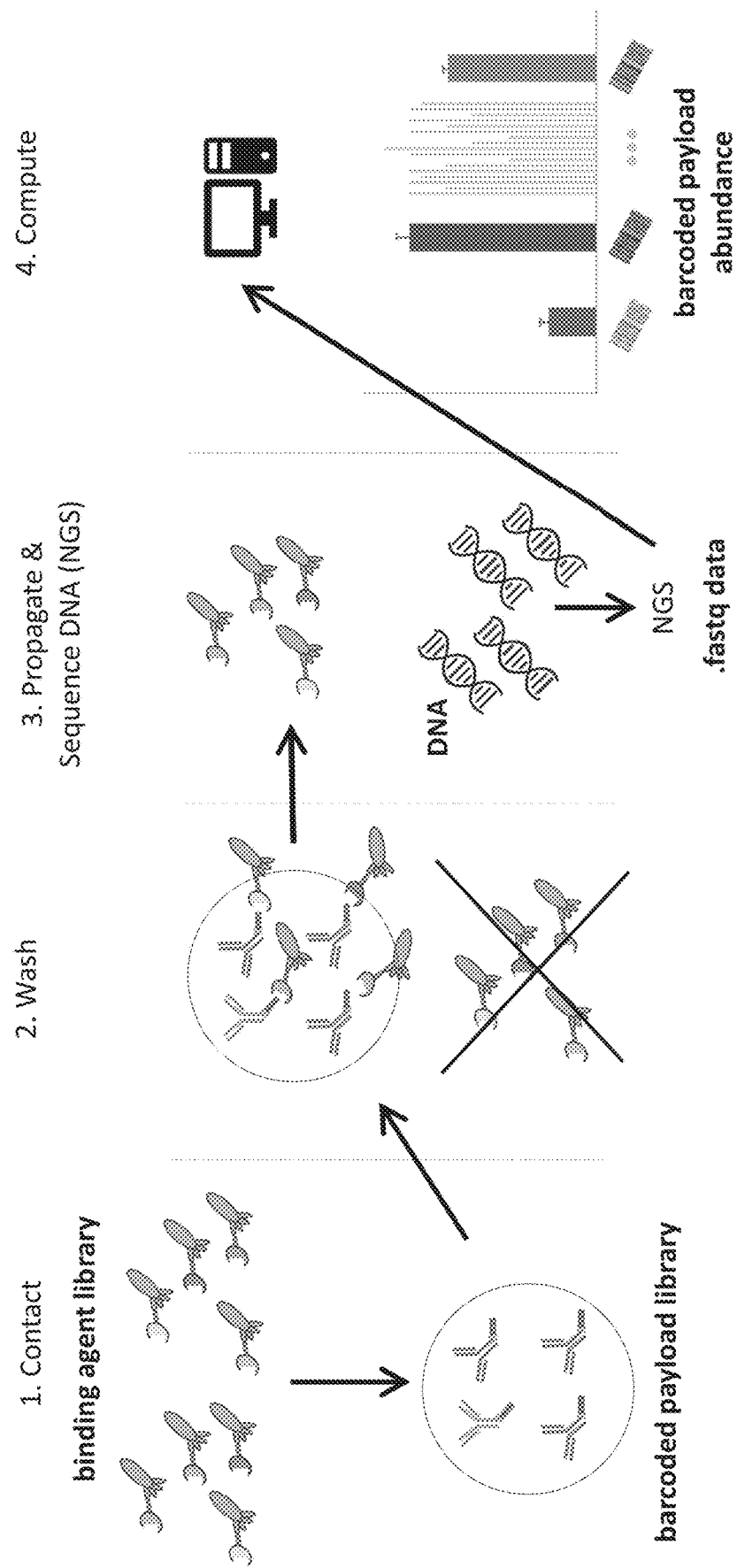
FIG. 2 is a schematic of a method to detect and/or quantify payloads (e.g. proteins) in a pool using barcodes and binding agents as described herein, according to an illustrative embodiment. A library of barcoded payload proteins is contacted with a library of binding agents containing identifying DNA. A wash step is applied that removes binding agents that do not associate (e.g. link (e.g. form strong linkages)) to any of the barcoded payload proteins, while leaving only binding agents that associate with barcodes. Following the wash, a process of DNA sequencing is applied to associated binding agents. In some embodiments, sequencing may be performed using next-generation sequencing (NGS) (e.g. as operated by an Illumina sequencer). The relative abundances of DNA sequences are reported as a computer file (e.g. fastq data). A computer algorithm is applied on the .fastq data combined with prior biophysical characterization of the binding agents to infer the abundance of each of barcoded payload proteins in a pool.

Cloning Barcode Library into Expression Plasmid:

The designed pool of barcodes was cloned into a pET expression vector to yield a barcode attached to a payload protein. A plasmid was constructed containing 6xHIS-HALO-TEV-LN-IIS-LC, allowing for direct cloning of the oligo pool via golden gate assembly. LN and LC represent the constant overhangs in the oligo pool used for ligation (FIG. 1B). 1 µg of vector was predigested with BsaI at 37° C. and purified. Oligo pools were amplified via Polymerase Chain Reaction (PCR). A 1:10 molar ratio of purified vector and insert were added to a golden gate assembly reaction using NEB golden gate assembly mix (Cat: E1601S), and incubated at 37° C. for 1 hour, then heat killed at 70° C. for 5 min. This material was then purified, drop dialyzed into pure $H_2O$ for 60 min, and electroporated into electrocompetent BL21 bacteria (lucigen). Serial dilution were plated to recover individual colonies. Colonies were then picked, grown in media containing 1% glycerol and 100 µg/ml carbenicillin, and glycerol stocked in 20% glycerol at −80° C. After cloning, a construct is generated containing a barcode attached to a protein using a linker (FIG. 1A).

Expression of Individual Barcodes:

Expression was performed either using in vitro transcription translation (IVTT) or BL21 induction. For IVTT, PCR was performed directly from glycerol stock by adding primers specific for T7 and T7 terminator sequences in BL21. The resulting amplicon contains T7 and T7 terminator for expression, and makes the protein 8xHIS-HALO-TEV-LN-Barcode-LC. 1 µL of PCR product, containing approximately 50 ng of DNA was added to a 10 µL IVTT reaction using NEBPure (cat no: E6800S) assembled according to the manufacturer's instructions. The reaction was then incubated for 4 hours at 37° C. For *Escherichia coli* (*E. coli*) expression, cultures were grown to an OD of 0.5 at 37° C., then induced using Isopropyl β-d-1-thiogalactopyranoside (IPTG) and grown overnight at 25° C. Cells were lysed the next day using sonication in the lysis buffer, and the lysed material separated from the inclusion bodies via centrifugation, taking the supernatant containing protein. Supernatant was purified using affinity chromatography Ni-NTA resin, and stored for future use.

Figure 3A:
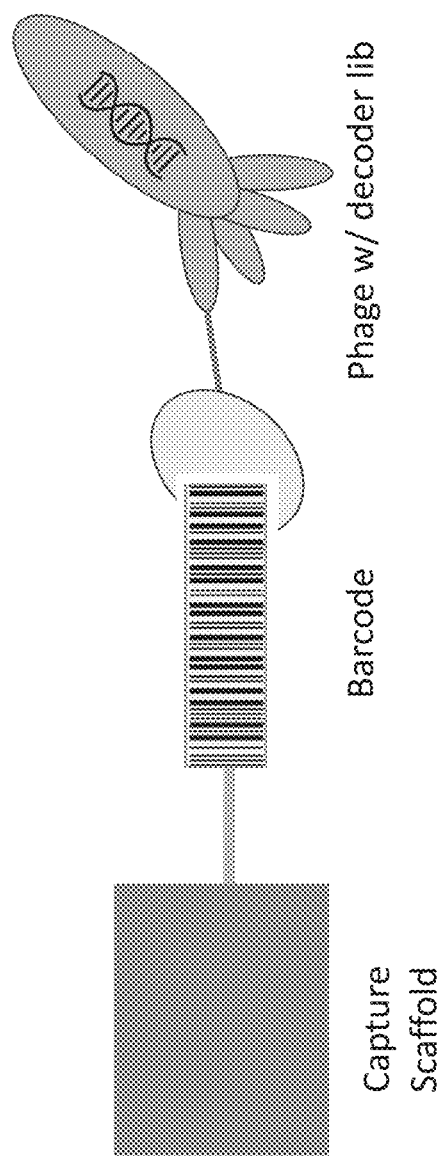
FIG. 3A is a schematic for capturing a barcode as described herein, so that it may be contacted by a binding agent as described herein, according to an illustrative embodiment. It illustrates a capture scaffold that may have a barcode associated with it (e.g. immobilized on its surface), and a binding agent (e.g. phage with binder expressed on its surface (e.g. with binder DNA in phage)) is contacted to characterize biophysical interaction. In some embodiments, the biophysical characterization is a measure of dissociation constant (Kd) between the binding agent and the protein barcode.

Capture of Individual Barcodes on HALO Magnetic Beads:

10 µL of IVTT was diluted to 50 µL in PBS supplemented with BSA at 1 mg/ml. To this mixture, 30 µL of Halo tag magnetic beads (cat: G7281) were added, and incubated with shaking at 400 rpm for 2 hours, then 4° C. with shaking overnight. Beads were captured on magnetic stand, and the supernatant removed. The beads were then washed 2× with PBS-T with 0.1% Tween 20 (PBS-T). A schematic of a captured barcode is shown in FIG. 3B.

Construction Of a Phage Display Library Containing Binders with Varying Affinities to Barcodes:

Binders with strong affinities to at least one barcode were generated via methods known to those skilled in the art (e.g. phage display, hybridoma, etc.). These binders were then displayed on phage as scFv fragments fused to m13 gene 3 protein (g3). Briefly, oligos containing the scFv binding sequences were generated via DNA synthesis. The oligo were cloned into a plasmid containing the constant regions of the scFv connected to G3 via a G4S linker (SEQ ID NO.: 8399) and myc tag. 30 µg of the library was electroporated into TG1 (lucigen) and plated on several 25 mm plates containing carbenecilin at 100 µg/ml and glucose 1%. Dilutions of electroporation were plated for diversity analysis. The Q trays were scraped and glycerol stocked. To produce phage, a 2L culture was inoculated at ~OD 0.05 and grown to OD 0.5 at 37° C. with 100 µg/ml carbenicillin and 1% glycerol. At OD 0.5, helper phage was added at a 10:1 phage:cell ratio, and incubated with shaking at 250 rpm. After 1 hour, shaking was reduced to 150 rpm and temperature to 30° C., and incubated overnight. The next day, phage was prepared via PEG precipitation (Barbas et al. 2001), resuspended in 10 mL, and titered. Phage was stored at 4° C. until use.

Figure 3C:
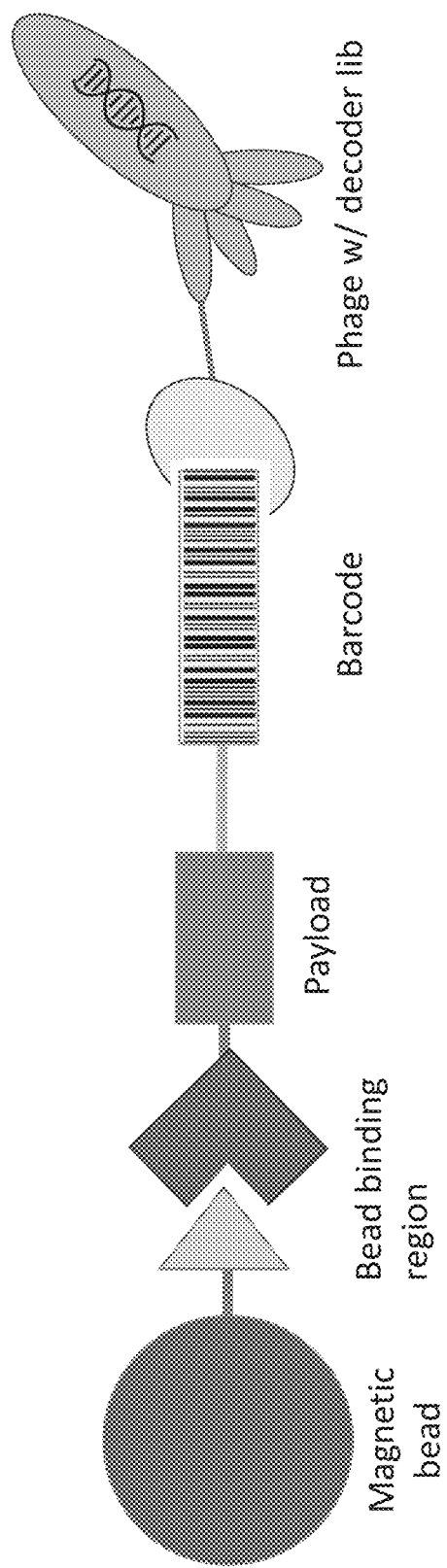
FIG. 3C is a schematic for capturing a barcode as described herein, so that it may be contacted by a binding agent as described herein, according to an illustrative embodiment. It is a schematic of a barcode-binder platform as described herein, according to an illustrative embodiment. The schematic shows a magnetic bead with an Fc/Protein A conjugated barcoded payload. To detect the captured barcoded payload, a binding agent (e.g. phage expressing a binder on its surface (e.g. phage with binder DNA/lib)) with known affinity to the barcode is bound to the immobilized payload. The DNA within the phage that encodes for the binder is then amplified and subjected to NGS to detect the payload.

Assessment of Phage-Binder-Barcode Interaction:

10 µL of the phage library prepared using methods described above was added to the captured barcode and incubated at room temperature for 2 hours, to allow binding of the phage to the barcode (FIG. 3C). After incubation, the mixture was washed by successive transfers of the magnetic beads to fresh PBS-T 3 times. Phage were eluted from beads by resuspension in PBS containing TEV protease+0.1% DTT and incubation at 37° C. for 30 min. Beads were collected on a magnetic stand, and the supernatant collected. To the supernatant, trypsin was added and further incubated for 30 min. To propagate phage, the supernatant was added to 50 mL of TG1 *E. coli* grown at 37° C. to an OD of 0.5 in 2xYT and incubated with shaking at 37° C. for 1 hour. Then 100 µg/ml carbenicillin and 1% glucose were added with incubation under the same conditions for 1 hr. Helper phage (cat: PH050L) was added and further incubated for 1 hour at 37° C. The culture was centrifuged and placed into new media containing 100 µg/ml carbenicillin and 50 µg/ml kanamycin, and incubated overnight at 30° C. Following this, centrifugation at 4000 g for 20 minutes was performed, and the supernatant containing phage was collected.

Analysis and Establishment of a Fingerprint for a Given Barcode:

After selection was performed from the original phage pool against each barcode individually, phage-scfv (i.e. phage-binder) selectivity was analyzed via NGS. Phage were lysed via heating at 98° C. for 10 minutes, and the resulting genomes were PCRed using primers which flank the CDR regions of both the heavy CDR3 (5 prime) and light chain CDR3 (3 prime). A second round of PCR was performed to add required illumina sequences (i5/i7, sequencing primer binding region) for NGS. The result DNA was pooled, quantified and subject to NGS using an Illumina instrument. This process is shown in FIG. 2 and FIGS. 3A-3C.

Figure 4:
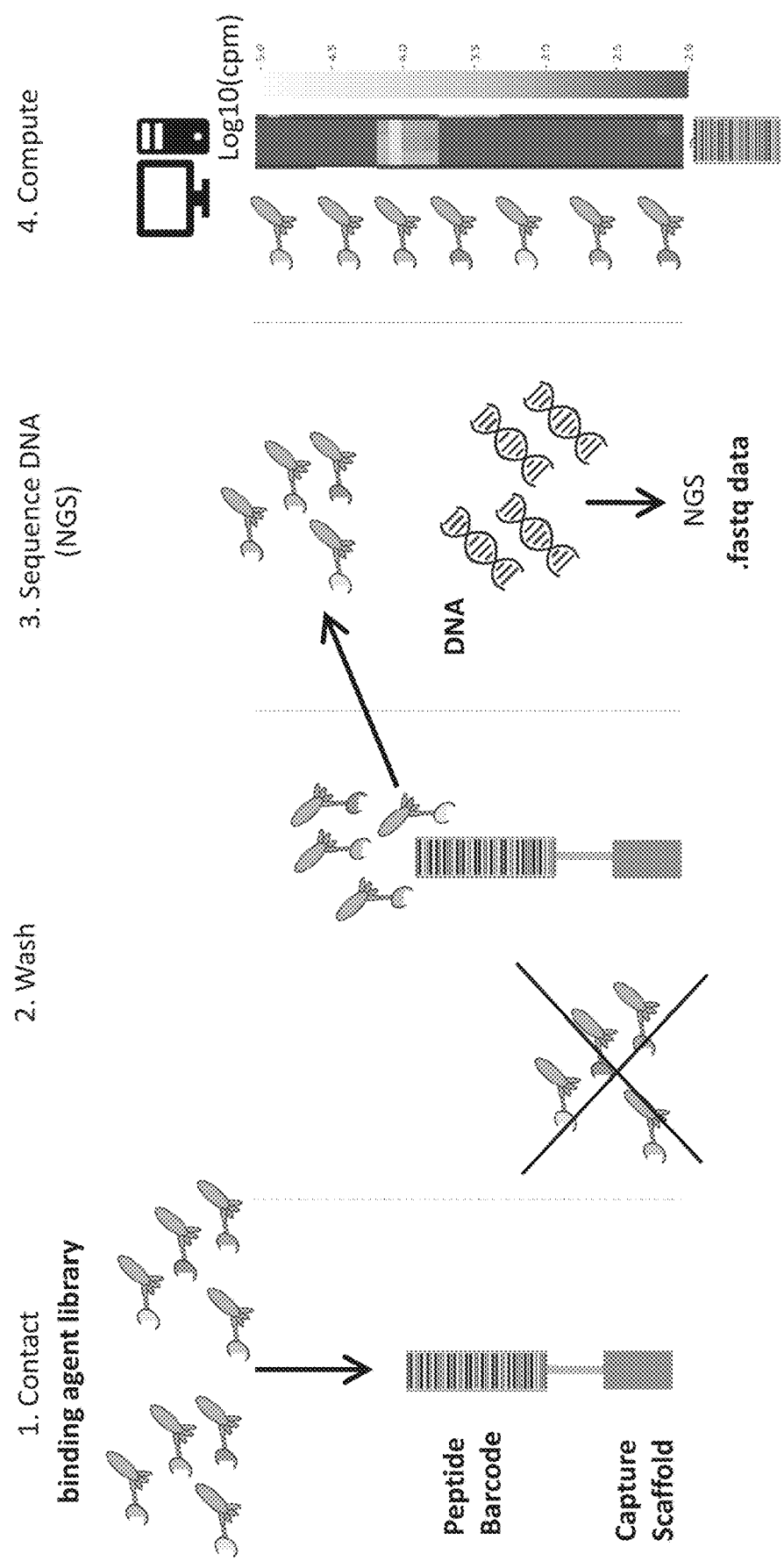
FIG. 4 is a schematic of a method to learn the barcode fingerprint of a given barcode as described herein, according to an illustrative embodiment. A peptide barcode displayed on a capture scaffold is contacted with a library of binding agents containing identifying DNA. A wash step is applied that removes binding agents that do not associate (e.g. link (e.g. form strong linkages)) with any of the barcodes, while leaving only binding agents that do associate with barcodes. After the wash, a process of DNA sequencing is applied to associated binding agents. In some embodiments, sequencing may be performed using next-generation sequencing (NGS) (e.g. as operated by an Illumina sequencer). The relative abundances of DNA sequences are reported as a computer file (e.g. in .fastq format). A computer algorithm is applied on the .fastq data to computer a barcode fingerprint. This is a vector of the relative counts of the members of the binding agent library. The method of learning a barcode fingerprint can be repeated for any barcode to identify a unique fingerprint. In some embodiments, steps 1-4 of FIG. 4 may be repeated, each time starting with a focused binding agent library in order to improve the fingerprint, for a barcode with an existing fingerprint or a new barcode. In some embodiments, the focused binding agent library is made by oligonucleotide library synthesis.

NGS reads are demultiplexed using the illumina software bcl-convert, such that each final .fastq contains the DNA sequences from a given phage CDR3 pair which correspond to the output from a given barcode well. The corresponding CDR3 sequences are then counted using a computer program, revealing the distribution of binders present for a given barcode. The fingerprint of a barcode corresponds to the vector of counts for each scFv binder within the given pool. Each fingerprint is the median of n=3 individual barcode replicates. The process and resulting fingerprint for a single barcode using the pool of phage binders is shown in FIG. 4.

Determination of Proportion of Barcodes in a Given Mixture Using a Fingerprint Matrix:

Once the fingerprints of each barcode of a set of barcodes have been determined, the proportions of barcodes in an unknown sample were measured in the following manner. The binder-barcode interactions were assessed as described above, and the resulting NGS readout was fit to a linear combination of the known fingerprints via least squares. That is, the coefficients of the linear combination are chosen by minimizing the sum of squares of the differences between the measured NGS count and the expected NGS count for all binding species as described in Example 8. The expected NGS count is given by the matrix product of the fingerprint matrix with a set of barcode abundance coefficients. Once the coefficients have been obtained, they are normalized to sum to 1 to obtain proportions.

Figure 5:
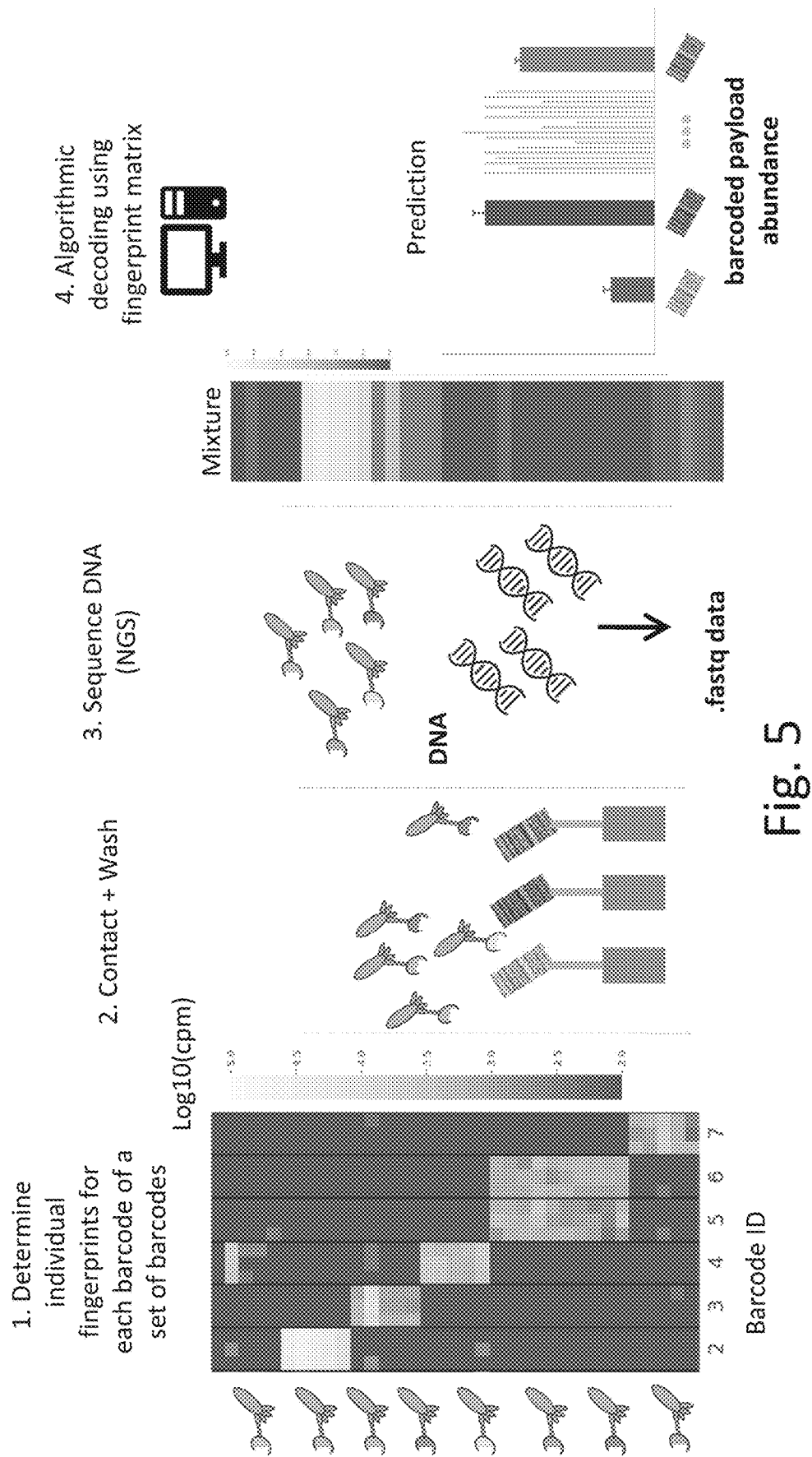
FIG. 5 is a schematic of a method to use a fingerprint matrix of a set of barcodes to determine the relative abundance of a mixture of barcodes, according to an illustrative embodiment. A set of barcodes for which individual fingerprints have been determined are combined together in a known ratio and displayed (e.g. on a scaffold) for subsequent contact with a binding agent library. A binding agent library is contacted with the set of barcodes and non-specific binding agents are washed away. The specific binding agents are quantified by NGS and reported as a mixed measurement computer file (e.g. in .fastq format). This data is provided to a computer algorithm that uses the mixed measurement to learn the relative scalings of readouts relative to the original fingerprints, and assembles the scaled fingerprints together into a scaled matrix. This scaled fingerprint matrix can then be used in further applications of quantifying relative abundance of barcoded payloads using these barcodes in which the computer algorithm is applied to the NGS reads from contacting a sample with a binding agent library.

Decoding of Equal Proportion Barcode Mixture to Asses Fingerprint Scaling:

In order to determine any scaling issues that may arise due to varying affinities between binders and barcodes, a scaling factor is generated via a measurement of barcodes mixed in equal proportions. Briefly, all barcodes validated are mixed at even concentrations after production. Phage binder interactions were assessed as described above, and the resulting phage was subject to NGS. Using the fingerprints determined for individual barcodes above, the proportion of barcodes in the mixture was estimated via least squares regression as described in Example 8. The proportions predicted using the least squares form the basis for scaling factors (sf) where sf=1/p, where p=proportion predicted. The process is described in FIG. 5.

Assessment of Mixtures of Barcodes of Known Proportions:

Barcodes produced above were mixed at known proportions and subject to assessment to determine their accuracy. Barcodes where mixed at different proportions (FIG. 6A), and then analysis of phage binder (i.e. binding agent) interactions was performed as described above. The NGS counts for each binder within the pool were counted. Least squares was used to determine the proportion of barcodes given the fingerprint constructed above using single barcodes. Predictions from the least squares analysis were then rescaled using the established scaling factor by p'=p*sf, where p' is the new prediction, p is the original prediction and sf is the established scaling factor. The new predictions are then re-normalized to sum to 1.

FIG. 6B shows the accuracy of proportion measurement for this method. Six (6) different barcodes were measured, normalized via a scaling factor, and relative barcode proportions were estimated with a global pearson correlation of 0.95 across all measurements made. Measurements were across a 100 fold gradient of barcodes. FIG. 6C shows a plot of NGS count values, normalized to counts per million, for each single barcode measurement as well as mixture that were used to predict the relative abundance of each barcode within the mixture. Rows are experiments, thus all values in a row are generated from a single .fastq file and columns are binding agents.

Example 2: In Vitro Detection of a Payload in a Mixture Using Binder-Barcode Platform The present example demonstrates a method of measuring the presence or absence of a given payload in a mixture using a binder-barcode platform as described herein.

Figure 6:
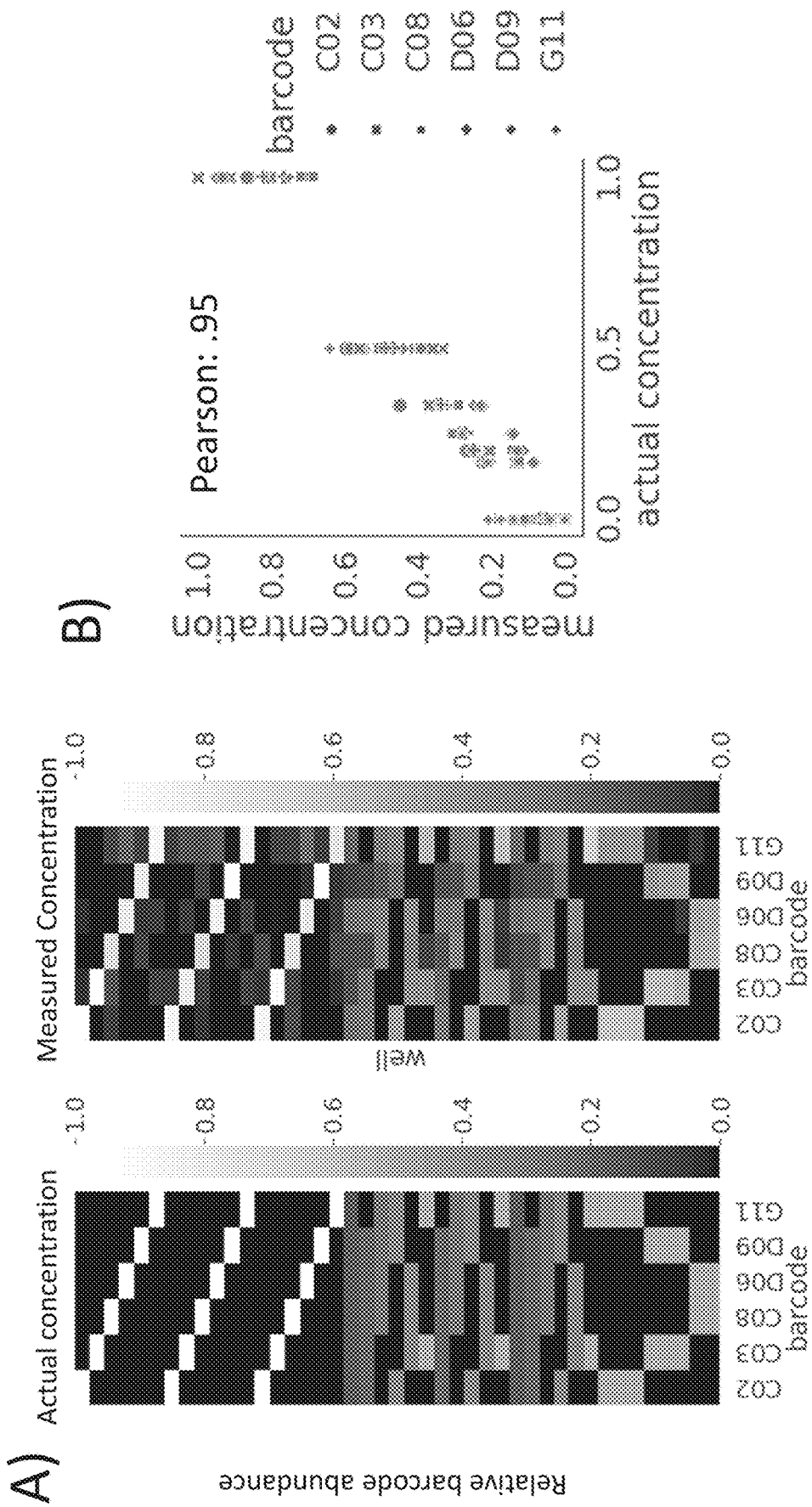
FIG. 6 shows results of quantifying a complex mixture of barcodes. Up to 6 barcodes were pooled and then measured using the decoding method described herein. (A) shows the actual relative proportion of a given barcode (left panel) and the measured relative proportion of a given barcode (right panel). Rows are individual experimental conditions, columns are barcodes, color is measurements (100% barcode=white, 0% barcode=black). (B) shows a plot of measured concentration of barcodes against actual concentration of barcodes for all experiments compared across all barcodes. Across all experiments and mixtures, a pearson of 0.95 between measured and actual proportions was calculated. (C) shows a plot of NGS count values, normalized to counts per million, for each single barcode measurement as well as mixture that were used to predict the relative abundance of each barcode within the mixture. Rows are experiments, thus all values in a row are generated from a single .fastq file and columns are binding agents.
Figure 9:
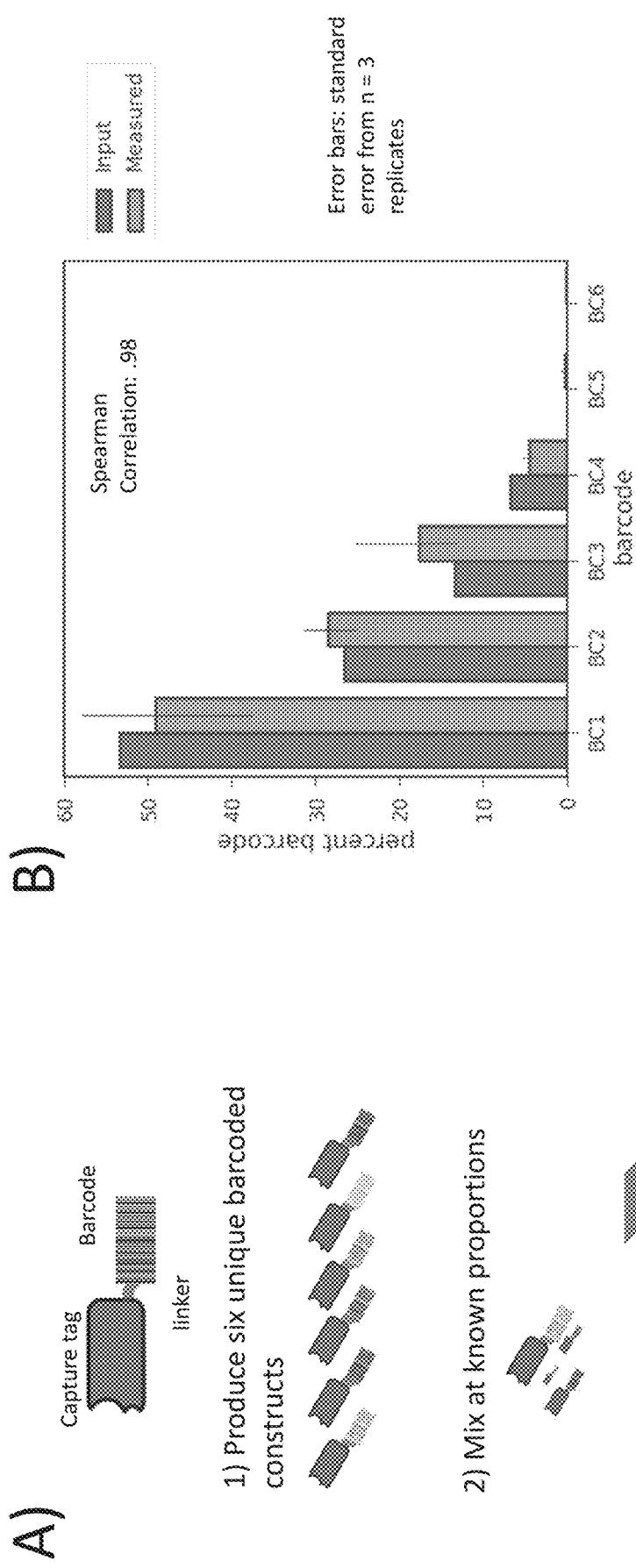
FIG. 9 (A) shows schematic of description of experiment provided in Examples 1, 2, and 8. Six unique barcodes (BC1. BC2, BC3, BC4, BC5, and BC6) were mixed at known proportions, contacted with binding agents, and subjected to decoding as described herein. Two barcodes were experimentally held out as negative controls, but prediction for these barcodes was allowed, thus allowing determination of background prediction. (B) and (C) show data on accuracy of decoding procedure across a 10-fold range of concentrations for the 6 unique barcodes. (B) shows plot of actual data (input) and measured data obtained after decoding for one mixture of known barcode concentrations. Input known concentrations (left bar) are shown next to predictions/measured data (right bar) for each barcode across 3 replicates. (C) shows plots of actual data (input) and measured data obtained after decoding for five different mixtures (i.e. pools 1-5) of known barcode concentrations. Input known concentrations (left bar) are shown next to predictions/measured data (right bar) for each barcode across 3 replicates.

Barcodes generated in Example 1 were transferred onto a novel payload using DNA cloning. Briefly, barcodes were amplified out of the pET 6xHIS-HALO-TEV-LN-Barcode-LC such that the LN-Barcode-LC part is amplified. The barcode insert was cloned using gibson into a new pET vector containing 6xHIS-Payload-LN-Barcode-LC, where payload was a novel protein of interest. Payload-barcodes were produced in E. coli as described above. Barcoded payload proteins are then purified via affinity chromatography using Ni NTA, washed in 500 mM NaCl, 50 mM Tris-HCl, 50 mM imidazole, and eluted using 500 mM imidazole. Barcoded payload proteins were then subject to decoding using the phage binder library described in Example 1. FIGS. 6, 9, and 12 show experimental setups to detect payload using barcodes previously generated in a different context, and results of such experiments thus showing these barcodes contain generalized detection properties across varying numbers of barcodes within a pool.

In the experiment described in FIG. 9, six unique barcodes (BC1, BC2, BC3, BC4, BC5, and BC6) were mixed at known proportions, contacted with binding agents, and subjected to decoding as described herein (FIG. 9A). Two barcodes were experimentally held out as negative controls, but prediction for these barcodes was allowed, thus allowing determination of background prediction. FIGS. 9B and 9C show data on accuracy of decoding procedure across a 10-fold range of concentrations for the 6 unique barcodes. FIG. 9B shows plot of actual data (input) and measured data obtained after decoding for one mixture of known barcode concentrations. Input known concentrations (left bar) are shown next to predictions/measured data (right bar) for each barcode across 3 replicates. FIG. 9C shows plots of actual data (input) and measured data obtained after decoding for five different mixtures (i.e. pools 1-5) of known barcode concentrations. Input known concentrations (left bar) are shown next to predictions/measured data (right bar) for each barcode across 3 replicates.

In the experiment described in FIG. 12, the quantification of up to 24 barcodes contained within a single mixture was determined. FIG. 12A shows a graphical depiction of the experiment. Of 24 total barcodes the algorithm can predict, 10 were present within a mixture at equal concentrations. The rest were held out from the pool, but prediction was computationally allowed. Three (3) separate pools, which cover all possible barcodes were measured in replicate. These pools were mixed, then captured on HALO beads, described in Example 1. The immobilized barcoded payload was then contacted with a pool of binding agents (i.e. binding agents with binders expressed on them), and decoded to CDR3 sequence counts as described in Example 1. The CDR3 sequence counts, determined via NGS, were then utilized to determine the presence and total concentration of each barcoded payload in the sample via decoding (see Example 8). FIG. 12B shows prediction for the first pool; the input concentration (left bar) and measured concentration (right bar) are plotted for each barcode in the pool. FIG. 12C plots predictions for each of the three pools. As in FIG. 12B, the bar graphs plot input concentration on the left and measured concentration on the right. FIG. 12D shows the barcode fingerprint for each of the 24 barcodes used to computationally determine the relative abundance of the barcodes within each of the 3 pools. Columns represent barcode fingerprints, and rows represent binding agent fingerprints. FIG. 12E shows the binding agent counts from the three pools, used to computationally determine the proportion of the pools. Rows are the binding agent counts, columns are the pools, and each cell is the binding agent count within a specific pool.

Example 3: In Vitro Assessment of Payload Stability within a Pool of Payloads Using Binder-Barcode Platform The present example demonstrates a method to determine the general aggregative tendencies of several payloads in a pool using barcode decoding.

A purified pool of barcoded payloads is generated using the method described in Example 2. The purified pool is then subject to size exclusion chromatography using standard methods. Different fractions are collected—corresponding to monomeric vs aggregated payloads. The general presence or absence of a given barcoded payload within the purified pool is not known. The separated fractions, containing an unknown abundance of each barcoded payload, are then immobilized on beads or immunosorbent assay plates, contacted with a pool of binders (i.e. binding agents with binders expressed on them), and decoded to CDR3 sequence counts as described in Example 1. The CDR3 sequence counts, determined via NGS, are then utilized to determine the presence and total concentration of barcoded payloads in each fraction. The concentration of barcoded payloads in the different fractions are then compared to determine the percent of each barcoded payload which is monomeric vs aggregated within the purified pool.

Example 4: In Vivo Assessment of Payload Pharmacokinetics within a Pool of Payloads Using Binder-Barcode Platform The present example demonstrates a method to determine the overall residence and clearance time of a given payload, contained within a pool of payloads, using a mouse model, as demonstrated in FIG. 11.

Three pools of barcoded payloads were injected into three different groups (pool 1 in to group 1; pool 2 in to group 2, and pool 3 in to group 3) of mice (n=3). Pool one contained a single barcoded antibody at 10 mg/kg. Pool two contained two barcoded antibodies pooled at equal concentrations and injected at 20 mg/kg. Pool three contained PBS only. Injection volumes were held constant at 100 μL per pool. At 24 hours after injection, blood was collected from each mouse and serum separated. 10 μL of serum was diluted 1:10 in PBS and captured using anti-human IgG magnetic beads (Ray biotech cat #801-101-1) by incubation overnight at 4° C. with mixing at 700 rpm. The immobilized barcoded payloads were washed using PBS-T three (3×) times, to remove all serum proteins not associated with the affinity reagent. The immobilized barcoded payload was then contacted with a pool of binding agents (i.e. binding agents with binders expressed on them), and decoded to CDR3 sequence counts as described in Example 1. The CDR3 sequence counts, determined via NGS, were then utilized to determine the presence and total concentration of each barcoded payload in the sample via decoding (see Example 8). The proportion of barcoded payloads measured at 24 hours was compared to the injected concentration to determine the relative rate of clearance for each barcoded payload from the organism. In each of the groups, only the injected barcoded antibody was detected by decoding as evidenced by the graph plotted in FIG. 11, with high accuracy. In group 2 mice, which were injected with pool 2 that contains both antibodies at equal concentrations, slightly differing amounts are measured via decoding in the serum at 24 hours. It is hypothesized that this difference is due to differences in clearance rates between the two barcoded antibodies. As expected, the control group showed almost no antibody.

Example 5: In Vivo Assessment of Payload Biodistribution Using Binder-Barcode Platform The present example demonstrates a method to determine the overall distribution of a barcoded payload across a diverse set of tissues using a mouse model.

A pool of purified payloads is injected intravenously into a BALB-6 mouse. After at least 24 hours, different tissue samples, such as liver, lung, and brain, are taken from the organism. The tissues are then processed into a single-cell suspension via vigorous shaking with beads. The suspension is then lysed using a lysis buffer to liberate the barcoded payloads (e.g. barcoded proteins) contained within the tissues. The lysed suspension is then purified using a universal tag affinity reagent contained within the payloads to separate the barcoded payloads. Purified barcoded payloads are then immobilized, and barcode decoding is performed according to method described in Example 1. The CDR3 sequence counts, determined via NGS, are then utilized to determine the presence and total concentration of each barcoded payload in each sample. Payload abundance across different tissue samples is then compared, to determine the percent of each payload which is contained within each tissue. This data may then be used to select the best payload with specific biodistribution properties.

Example 6: In Vitro Demonstration of Recovering Known Mixture of Unmodified Antibodies The present example demonstrates how a known mixture of antibody proteins with no barcode attached was quantified using the protein quantitation invention described herein.

Figure 7:
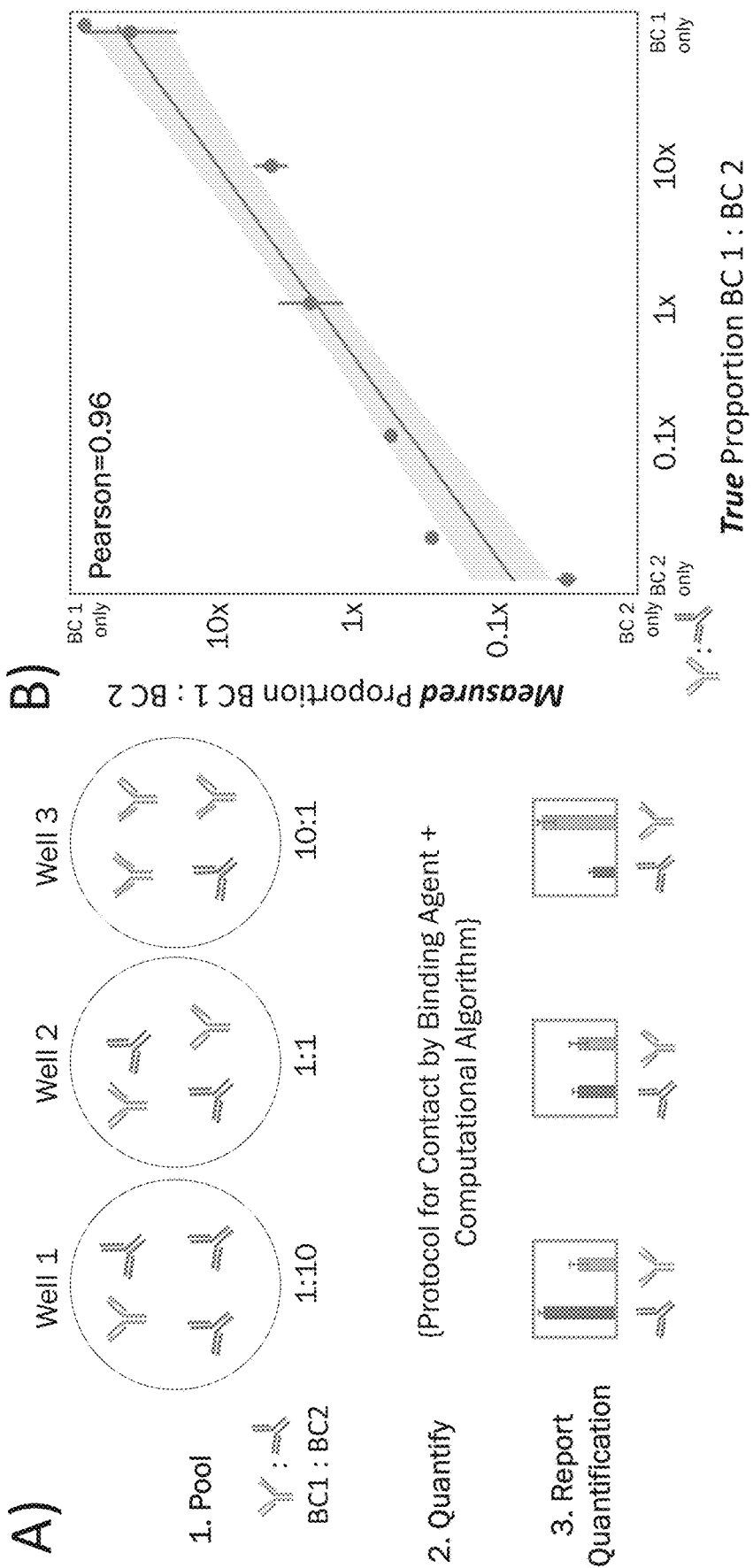
FIG. 7 shows a schematic of a method and data obtained using the decoding method on payload proteins with barcodes contained within internal regions of the protein sequences (i.e. endogenous barcodes). The schematic shows results from a synthetic pooled barcode measurement assay. (A) shows two barcoded payloads (BC1 and BC2) were combined together at various known concentrations in different wells of a 96-well plate. Each mixture was subjected to contact with the same pool of binding agents and decoded as described herein. Each mixture was quantified and then compared to the known values of the barcoded payloads. (B) shows relative actual proportions (X axis) of each barcode correlate to relative measured proportions (Y axis) with a pearson of 0.96

Briefly, scFv binders to the antibodies were generated using methods known to those skilled in the art. The binder were then cloned and displayed on phage as described in Example 1. The two antibodies of interest were expressed in CHO cells and purified from the media using Protein A affinity chromatography. Antibodies were mixed together in known proportions (FIG. 7A). Antibodies were then captured using 50 μL anti-Human Fc magnetic beads and incubated in PBS. The antibodies were then subject to phage assessment as described in Example 1, and the relative abundance of each antibody estimated using the algorithm described in Example 8. An accuracy of pearson 0.96 at determining the relative concentration of these two antibodies in varying proportion mixtures was calculated (FIG. 7B).

Example 7: In Vitro Demonstration of Recovering Known Mixture of Antibodies in Presence of Serum The present example demonstrates how a known mixture of antibody proteins with barcodes contained within internal regions of the protein sequences was quantified in mouse serum using the protein quantitation technology described herein.

Figure 8:
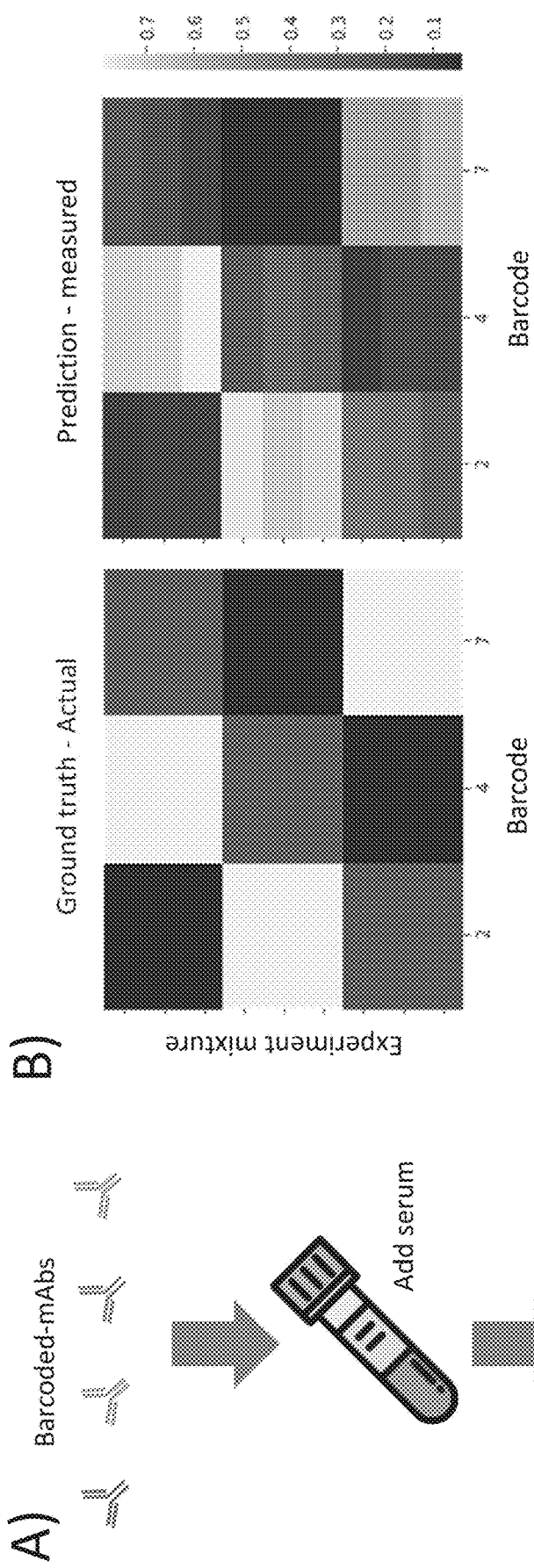
FIG. 8 shows a schematic of a method to detect protein payloads in serum using the barcode-binder platform as described herein, according to an illustrative embodiment. The payload proteins have barcodes contained within internal regions of the protein sequences (i.e. endogenous barcodes). (A) shows the barcoded therapeutic antibody agents of interest (barcoded-mAbs) were mixed at known concentrations and then added to serum. The barcoded payloads were then purified, contacted with binding agents, and subjected to decoding. (B) shows the relative actual barcoded antibody proportion (left) and the relative measured antibody proportion (right) for 3 experimental conditions, with 3 replicates each. Rows correspond to experimental condition, columns to barcodes, and color of heat-map cell is a measure of the proportion of barcoded antibody present. (C) shows a scatterplot of all the data across all experimental conditions for all barcodes with a Spearman correlation of .926 across all experimental measurements.

Briefly, antibodies were produced as described in example 6, and a similar experiment was performed, except after production, the antibodies were mixed with mouse serum, incubated at 37° C. for 30 minutes, and then captured using anti-Fc magnetic beads (FIG. 8A). The immobilized barcoded antibodies were then contacted with a pool of binding agents (i.e., binding agents with binders expressed on them), and decoded to CDR3 sequence counts as described in Example 1. The CDR3 sequence counts, determined via NGS, were then utilized to determine the presence and total concentration of each barcoded antibodies in the sample via decoding (Example 8). The relative concentration of three antibodies was estimated with a spearman of 0.926 across 3 mixtures of antibody concentration as shown in FIG. 8B and FIG. 8C. These results show the ability using technologies described herein to rank the antibodies present in a sample with high accuracy after incubation with serum i.e. in a complex environment.

Example 8: Detailed Description of the Decoding Algorithm Used to Infer Barcode Abundance Method of Inferring, Barcode Amounts:
Before decoding an unknown sample, a set of barcodes and its interaction with a binder pool (i.e. phage binder pool) must first be characterized. This is done by decoding a set of known samples under known conditions. The binder pool and experimental conditions is held fixed between all samples.

To characterize a set of barcodes, we measure a set of fingerprints, one for each barcode. A fingerprint represents the ideal readout of an individual barcode. Roughly speaking, it is the spectrum of affinities between a given barcode and all the binder species in the pool. A fingerprint can be estimated by decoding multiple identical samples containing purely one barcode, averaging together the readouts of the replicates, and rescaling accordingly. Alternatively, fingerprints can be learned by decoding samples containing known mixtures of barcodes and deconvoluting appropriately to isolate individual fingerprints. Together, the fingerprints of a set of barcodes is known as a "fingerprint matrix".

Once the fingerprint matrix of a set of barcodes is determined, it can be used to infer the barcode composition in an unknown sample. The decoding algorithm accomplishes this by fitting the readout of the unknown sample to a linear combination of fingerprints. This is described in further detail in the algorithmic section described herein. A key assumption of the algorithm is that the decoding process is linear: if a sample contains two barcodes mixed in equal proportions, it is assumed that its readout is equal to the sum of the fingerprints of the two barcodes (plus noise). More generally, the readout of a mixture of barcodes is assumed to be the sum of the fingerprints of each barcode, appropriately weighted by its prevalence in the mixture. This assumption has empirically been found to be true.

The task of barcode quantification has varying levels of difficulty. From easiest to hardest, these include Binary classification: detecting the presence or absence of a barcode in a sample Rank-order quantification: ranking barcodes from most to least prevalent in a sample Relative quantification: determining the ratios between barcodes in a sample Absolute quantification: determining the absolute amount of each barcode in a sample In this Example, absolute quantification is discussed in further detail.

Mathematical Model of Decoding:

The decoding process can be represented with the following mathematical model, where:

x is a length-n vector representing the input sample and each entry is the amount of a barcode species in units of ng; y is a length-m vector representing the bound binder fraction and each entry is the number of particles of a binder species in units of pfu; z is a length-m vector representing the NGS readout and each entry is the number of counts for a binder species.

The bound binder fraction is modelled as a linear combination of fingerprints, and the NGS readout is modelled as multiplying the bound binder fraction by a conversion factor:

$$y_j = \sum_{i=1}^{n} A_{ji} x_i + \epsilon_1$$

$$z_j = s_j y_j + \epsilon_2$$

where $A_{ji}$ is the fingerprint matrix, an m by n matrix with units of pfu bound per ng of barcode. The 'ji' entry represents the propensity for barcode i to bind binder j in the binder pool; $s_j$ is the conversion factor between pfu bound and number of NGS reads for binder species j; $\epsilon_1$ is noise associated with the binding steps; $\epsilon_2$ is noise associated with the post-binding steps.

The model assumes that binding between barcodes and binders is linear. In other words, if a sample contains a mixture of barcodes, its readout is assumed to be equal to the sum of the fingerprints of the individual barcodes, weighted by the relative barcode abundances. In Appendix A we provide a detailed biophysical model which justifies the linear assumption under one key condition: the amount of available binder cannot be significantly depleted by binding to the barcodes in the sample. Thus, as in typical immunoassays, the binding agent must be in excess and cannot be the limiting reagent.

Fingerprint Matrix an:

Each column of the mn-fingerprint matrix is a fingerprint. Each fingerprint represents the ideal, properly normalized readout of a pure barcode. The entry $A_{ji}$ represents the contribution of the fth binder to the fingerprint of barcode i.

The fingerprint of a barcode depends on the binding affinity to all the binders in the pool as well as the relative abundance of each binder species in the pool. Furthermore, the fingerprint is sensitive to the binding, equilibration, and elution steps. In the simplest case, the fingerprint matrix is given by $$A_{ji} = d_j / K_{ji}$$

where $d_j$ is the concentration of binder j in the binder pool, and $K_{ji}$ is the dissociation constant of the complex between barcode i and binder j (see Appendix A). In more complicated cases, $A_{ji}$ could also include effects of adhesion to surfaces, unbinding during washing steps, etc.

The matrix product of A with a barcode mixture x gives the composition of the ideal bound binder fraction (i.e. in absence of noise), in units of number of phage particles.

The fingerprint matrix can be determined from measuring the readout of multiple known samples. Multiple replicates are performed to average over noise. In addition, the fingerprints are properly scaled, either with respect to one another or to an absolute standard (see the Normalization section).

Conversion Factors $s_j$:

The post-binding steps introduce a conversion factor between the number of bound phage particles to the number of NGS reads. This is represented by $s_j$. In the simplest case, $s_j$ is identical for all binder species and represents an overall normalization, $$s = C / \sum_{j=1}^{m} y_j$$

such that the total number of reads/counts is C. This models the situation where there is some sort of bottleneck in the processing, such as saturation of the propagation culture, such that the end result is a fixed number of reads, irrespective of the amount of bound phage. In a more complicated case, $s_j$ could depend on the binder species, reflecting amplification bias or differential phage fitness in propagation.

In the case where the conversion factor is identical for all binder species, it is a single number which must be determined on a sample-by-sample basis. This can be done by using a DNA sequence spiked in at some point of the process (as described herein).

Noise $\epsilon$:

Noise sources are represented by the terms $\epsilon_1$ and $\epsilon_2$. In the absolute simplest case, $\epsilon_1$ is absent and is $\epsilon_2$ is Gaussian noise of fixed variance, in which case prediction can be done with ordinary least-squares regression. In reality, the noise arises from multiple, non-Gaussian sources, as detailed in the sections above. These include log-normal noise involved with exponential steps, such as phage propagation and PCR amplification. Poisson noise due to finite sequencing depth (and possibly stochasticity in binding/elution at low concentrations), and Gaussian noise from all sorts of other processes, such as sample degradation, etc.

Conversion from Read Counts to Phage Counts:

One feature of the NGS is that the readout is a relative measurement: it gives the ratio of abundances between different binder species, but not necessarily the absolute concentrations of binder species. To obtain an absolute readout, the raw readout must be divided by a conversion factor between the number of phage particles bound and the NGS read count.

Without knowing the conversion factor, it is only possible to determine the relative abundances of barcode in a sample (i.e. proportions). Absolute quantification requires a reference of known concentration (either barcode or binder) to be spiked into the process.

Methods of Absolute Quantification:

Spiking in a Phage Ladder in Elute:

One method of normalizing is to add a unique binder species into the elute at a known concentration, $y_{spike-in}$. This reference species should be distinct from the existing binders in the pool. In the subsequent steps (where the eluted phage are propagated. DNA extracted, PCR'ed, and sequenced), the reference phage will be amplified by (ideally) the same factor as the other phage in the pool, i.e.

$$z_{spike-in} = s \cdot y_{spike-in}$$

The conversion factor can be estimated by dividing the number of reads corresponding to the reference phage by the (known) concentration at which it was added, i.e.

$$\hat{s} = y_{spike\_in} / z_{spike\_in}$$

A generalization is to spike multiple binder species into the elute. Each reference species can be spiked in at a different concentration. If the concentrations are evenly spaced, this forms a "phage ladder", in analogy with ladders used in gel electrophoresis. To estimate the conversion factor, the number of reads of each reference sequence can be compared to the (known) concentration at which it was added to the elute. Averaging across the species then yields a more precise estimate of the conversion factor.

Spiking in Barcode into Sample:

Alternatively, a reference barcode of known concentration can be added to the sample at the beginning of the decoding process. This reference barcode should be distinct from the existing barcodes in the sample. The decoding algorithm can use the raw readout to determine the proportions of all barcodes within the sample, including the reference and the sample barcodes. By dividing the reference barcode concentration by its predicted proportion, a barcode conversion factor can be determined. Multiplying all the predicted proportions by this factor then yields the absolute abundances of barcode.

Note that this method is only applicable for decoding an unknown sample after a set of properly normalized fingerprints has been determined.

Scaling Fingerprints:

An important subtlety is that readouts have to be scaled even in the case of relative quantification. Specifically, the fingerprints of a set of barcodes must be properly scaled with respect to one another. Intuitively, this is because raw, unscaled fingerprints cannot be directly compared between barcodes, the read count of a binder has a different meaning in the context of a different barcode's fingerprint, because each barcode has a different conversion factor between bound binder count and read count. To ensure that fingerprints are measured in the same units, each unscaled fingerprint must each be scaled by (the inverse of) its conversion factor.

To illustrate this, consider a case with two barcodes. Suppose that, due to differences in binding affinity across the binder pool, the total amount of binder bound to 100 ng of barcode A is 10 times greater than that bound to 100 ng of barcode B. However, due to the nature of the method, the raw readouts end up having the same number of reads. In this example, one NGS read in barcode A's raw fingerprint corresponds to 10 reads in barcode B's raw fingerprint. The conversion factors are different. Now consider a sample containing a 1:1 mixture of the two barcodes. Due to the difference in affinity, the bound binder fraction in this sample is 10:1; consequently, the number of NGS reads corresponding to A and B would also be in a 10:1 ratio. In other words, the readout is proportional to 10a+b, where a is the raw readout of A and b is the raw readout of B. On the basis of this, one would come to the incorrect conclusion that A and B are in a 10:1 ratio. To correct for this, the raw fingerprint of barcode A must be multiplied by a factor of 10, compared to B, to obtain a correctly scaled fingerprint, a'=10a and b'=b. Now, when the two barcodes are mixed in equal proportions, the correct result is determined: the readout is an equally weighted mixture of the two correctly scaled fingerprints, a'+b'.

This example shows that the relative scaling factor between barcodes' raw fingerprints can be determined by measuring the readout of a known mixture of the barcodes. If the barcodes are mixed in equal proportions, the composition of the mixture readout will be each raw fingerprint, weighted by their scaling relative to each other. (Note that this gives only the relative conversion factor between the barcodes and not an absolute conversion factor to absolute barcode quantities.)

The Decodine Algorithm:

There are two phases of the decoding algorithm:

"Training phase": Learn the fingerprint matrix $A_{ji}$ by measuring the readout of a number of known samples "Testing phase": Predict the barcode amounts in an unknown sample by measuring the readout and comparing it to $A_{ji}$ Training Phase: Learning the Fingerprint Matrix In the training phase, the fingerprints of a set of barcodes are determined by measuring the readouts of a set of samples with known composition. The fingerprints must be correctly scaled with respect to one another. One method of measuring the fingerprint matrix is outlined below.

First, a set of samples, each containing purely a single barcode are prepared. Each sample is decoded. The fingerprint of each barcode is estimated by taking multiple replicates of a barcode and averaging together their readouts. The error is reduced if more replicates are averaged. This yields an unscaled fingerprint for each barcode.

Next, the fingerprints are correctly scaled with respect to each other. This is done by multiplying each of the unscaled fingerprints by a scaling factor. To determine the scaling factor of each barcode, a sample consisting of all barcodes mixed in equal proportion is decoded. Theoretically, this readout of this sample should be the sum of the normalized fingerprints of all the barcodes, weighted equally. However, if we fit this mixture readout to the set of unnormalized fingerprints determined from the previous step, the weights of the barcodes would not be equal. The coefficients to the linear fit are precisely the factor by which each barcode's fingerprint should be multiplied by to obtain a correctly normalized fingerprint. By averaging together multiple replicates of this, a more precise estimate of the scaling factors can be determined.

This method is detailed further below. Let $\tilde{A}$ be the unscaled fingerprint matrix obtained from averaging multiple unscaled measurements of single barcodes. Each column should sum to a fixed number of reads, so the units of $\tilde{A}$ are counts per million. The correctly scaled fingerprint matrix A is obtained by multiplying each column of $\tilde{A}$ by a rescaling factor S, such that $A = \tilde{A}S$, where S is a n×n diagonal "rescaling matrix". Here $S_{ii}$ is the scaling factor for the i'th barcode, with units of pfu eluted per count per million. Let y be the readout of a mixture of known composition x. One way to determine scaling factors is to use the unscaled fingerprint matrix to infer a set of "biased" predictions as $\tilde{x}=\tilde{A}^+y=SA^+y$, where $A^+$ is the pseudoinverse of $\tilde{A}$ (see the prediction section below). The ratio of the "biased" prediction to the actual amount is an estimate of the scaling factor: $S_{ii} \approx \tilde{x}_i/x_i$. Multiplying each unscaled fingerprint by this scaling factor gives our best estimate of the properly scaled fingerprint $A=\tilde{A}S$.

Note that there are other methods for measuring the fingerprint matrix. This present method only uses the single-barcode samples to determine (unnormalized) fingerprints, and the mixture samples to determine the scaling factors. More sophisticated methods may use uneven mixtures to determine scaling factors and/or use the information in these samples to better estimate the fingerprint (beyond just learning its scaling factor).

Testing Phase: Predicting Barcode Amounts in Unknown Samples

In the testing phase we are supplied with the readout y of an unknown sample x and we aim to infer its composition, $\hat{x}$. This is done by fitting the readout to a linear combination of fingerprints, $y=A\hat{x}$, where A is the (properly scaled) fingerprint matrix learned from the training phase.

The fitting is done by choosing a set of coefficients $x_j$, which minimizes a loss function. The loss function measures the deviation between the expected and measured readout. The expected readout is the matrix product $A_x$, based on the determined fingerprints and proposed mixture coefficients. In the simplest case, the loss function is a sum of squared errors, $$\mathcal{L}(\hat{x}) = \sum_{j=1}^{m} \left( \sum_{k=1}^{v} A_{ji}\hat{x}_i - y_j \right)^2 = \|A\hat{x} - y\|_2^2$$

and the inferred mixture composition is the minimizer of this loss, $\hat{x}=\text{argmin } L(x)$. If the number of binders is greater than the number of barcodes, then $A_x=y$ is an overdetermined system and there is a unique minimizer of the loss. The solution is given by $$\hat{x}=A^+y$$

where $A^+=(A^TA)^{-1}A^T$ is the Moore-Penrose inverse of the fingerprint matrix. If relative abundances (proportions) are desired, the coefficients can be normalized to sum to 1.

Note that the L2 loss function above is the simplest case. It is (proportional to) the negative log likelihood in the case where $\varepsilon_1$ is absent (no noise in binding) and $\varepsilon_2$ is Gaussian noise of fixed variance. To model more realistic forms of noise, other loss functions can be chosen.

Appendix A: Biophysical Model of Binding Process

Let n be the number of barcoded protein species in a sample, and let $x_i$, i=1, . . . , n be the concentrations of each barcode species added to the decoding well. Likewise, let m be the number of decoder species in the decoder pool, and let $d_j$, j=1, . . . , m be the concentrations of each decoder species added to the decoding well. Suppose that any decoder can interact with any barcode in a one-to-one stoichiometry to form a bound complex. A total number of nm such complexes can be formed, one for each barcode-decoder pair. Let $c_{ij}$, i=1, . . . , n, j=1, . . . , m be the concentration of a complex between barcode i and decoder j, and let $K_{ij}$ be the equilibrium dissociation constant characterizing the affinity of this interaction, with $\Delta G_{binding}=-RT \ln K_{ij}$.

For any decoder species, we assume that the amount which binds to the sample and subsequently eluted is given by $$y_j \equiv \sum_{k=1}^{m} c_{ij},$$

the bound complexes of that decoder summed over all possible barcode pairs.

In the simplest case, we assume that each species is an ideal solute in a dilute solution, and that the binding between barcodes and decoders is allowed to approach thermodynamic equilibrium. At equilibrium, some fraction of the decoders will bind to the barcodes, but there will still be remaining unbound barcodes, with concentrations $\tilde{x}_i$, i=1, . . . n, as well as unbound decoders, with concentrations $\tilde{d}_j$, j=1, . . . m.

The equilibrium state is given by minimizing the overall free energy of the system. This is shown to be equivalent to solving the following set of equations:

$$x_i = \tilde{x}_i + \sum_{j=1}^{m} c_{ij} \text{ for } i = 1, \ldots n$$

$$d_j = \tilde{d}_j + \sum_{k=1}^{n} c_{ij} \text{ for } j = 1, \ldots m$$

$$K_{ij} = \tilde{x}_i \tilde{d}_j / c_{ij} \text{ for } i = 1, \ldots, n, j = 1, \ldots, m$$

The first equation ensures the conservation of mass: the total amount of a barcode species is the unbound amount plus the amounts bound in complexes with all possible decoder partners. The second equation is an analogous statement for the decoders. The last equation is the definition of an equilibrium constant of a barcode-decoder pair.

The known values are the equilibrium constants $K_{ij}$ and the $x_i$ and $d_j$, representing the total concentration of each species of barcode and decoder, respectively, added to the well. The unknown variables are $\tilde{x}_i$, $\tilde{d}_j$, and $c_{ij}$. The values of the unknown variables are determined by solving the system of equations above.

The Linear Approximation

In the decoding process, a decoder pool with fixed values of $K_{ij}$ and $d_j$ is added to a sample of unknown barcode composition, $x_i$. The observable output of the binding process is the amount of each decoder species which binds to the sample, $$y_j \equiv \sum_{k=1}^{m} c_{ij}.$$

A key question of the binding process is how the input, the barcode concentrations $x_i$, affects the output, the bound decoder amounts $y_j$.

In general, the system of equations above is non-linear, but when certain conditions are met, the binding process can be well approximated by a set of linear equations. The decoding process is greatly simplified if the underlying equations are linear. A linear system implies that, at the least:

1) If the concentration of a barcode is doubled, the decoders bound to that barcode are all correspondingly doubled. (no saturation)

2) If two barcodes are mixed together, the decoders bound to the mixture are the sum of the decoders bound to each barcode alone. (no competition)

These two criteria can be thought of as linearity of single and multiple barcode detection, respectively. They are necessary, but not sufficient conditions.

To see how these criteria play in practice, consider the following binding situations which violate one or more of the criteria. Suppose that the decoder is the limiting reagent in a one-to-one stoichiometry of barcodes and decoders. Above a certain barcode concentration, all the available decoders would become saturated; an increase in $x_i$ would not lead to a proportional increase in $y_j$. Thus, to avoid saturation, the barcode concentrations should be kept below the Kd of the interaction (or the decoder concentration, whichever is greater—see below).

As another example, consider a situation where two barcodes A and B both have affinity for a certain decoder D, but barcode A has a much stronger affinity than barcode B. In the absence of A, the binding of barcode B has a certain binding curve. However, if there is enough A to deplete much of the available D, the binding of barcode B to the remaining D will be significantly altered. This is a situation where A and B compete for available decoder D. Note, however, that if the binding of A did not deplete the amount of D remaining in the pool, then the binding between B and D would not be altered by the presence of A. The competitive behavior occurs only in situations where the available D is significantly consumed by binding to A—if A is highly abundant and/or the A-D affinity is strong. In both examples of non-linear situations, one or more decoders in the pool is significantly depleted by binding to barcodes.

These examples indicate that the binding process is linear when a small fraction of the decoding pool is bound to the sample. Indeed, if this condition is met, the equations above can be simplified into a simple linear system. Under this assumption, the amount of unbound decoder d, is well approximated by the total amount of decoder, dg. If we further assume that the bound complexes deplete a small fraction of the available barcodes, then the system of equations simplifies to $$c_{ij} = x_i d_j / K_{ij}$$

and the output can be represented with a simple matrix multiplication, $$y_j = \sum_{i=1}^{n} A_{ji} x_i \text{ with } A_{ji} \equiv d_j / K_{ij}$$

Example 9: Assessment of Absolute Payload Abundance of a Single Test Barcode Using a Reference Barcode (or Spike-In Barcode)

The present example demonstrates a method to determine the absolute payload abundance of payloads in a pool using a reference barcode and barcode decoding.

Figure 10:
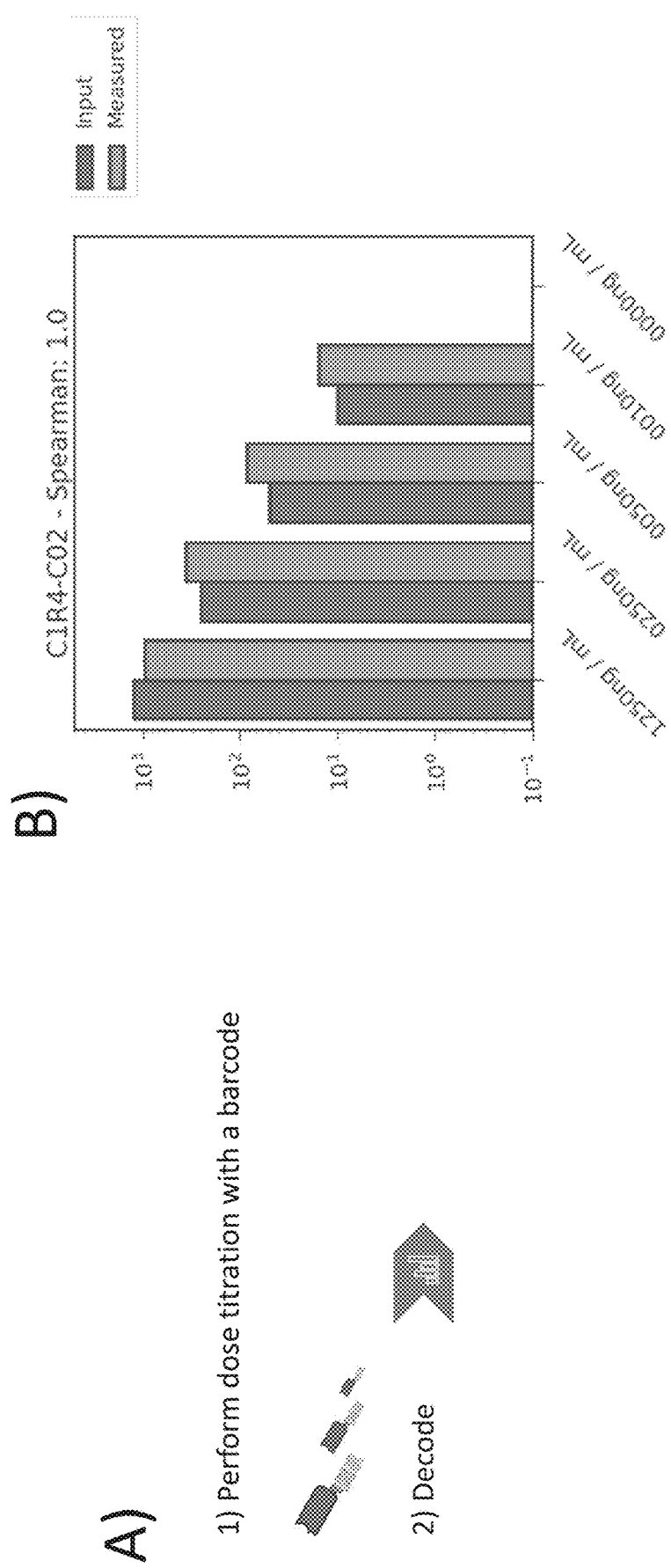
FIG. 10 shows a method and data for determining the absolute concentration of a single test barcode as described herein. (A) shows a schematic of the experiment. A single test barcode was assayed at several concentrations, while a "spike-in" barcode (i.e. a reference barcode) was added to each assay mixture at a known concentration. The various concentrations of the test barcode were contacted with binding agents and decoding was performed as described herein. The prediction of the "spike-in" barcode was used to determine the absolute amount of the test barcode being measured. (B) shows a plot of the measured absolute quantities of the test barcode (right bar) compared to known input concentrations of the test barcode (left bar) for each titration of the test barcode. The Y-axis is the logarithm of the test barcode concentration in nanograms per milliliter (ng/mL).

FIG. 10A shows a schematic of the experiment. A single test barcode attached to payload was assayed at several concentrations, ranging from 0 ng/mL to 1250 ng/mL. In the same sample, a "spike-in" barcode attached to a payload (i.e. a reference barcode) was added to each assay mixture at 250 ng/mL. The various concentrations of the test barcoded payload were contacted with binding agents (i.e. binding agents with binders expressed on them) and decoding was performed as described herein. The prediction of the reference or "spike-in" barcode was used to determine the absolute amount of the test barcode, and by extension the barcoded payload, being measured (see Example 8). FIG. 10B shows a plot of the measured absolute quantities of the test barcode (right bar) compared to known input concentrations of the test barcode (left bar) for each titration of the test barcode. The Y-axis is the logarithm of the test barcode concentration in nanograms per milliliter (ng/mL). FIG. 10C shows the results of determination of absolute concentration for 6 different barcoded payloads. The plots show known input concentrations (left bar) and measured concentration (right bar) for six (6) different barcoded payloads.

REFERENCES

Towbin H, Staehelin T. Gordon J. Electrophoretic transfer of proteins from polyacrylamide gels to nitrocellulose sheets: procedure and some applications. Proc Natl Acad Sci USA. 1979; 76(9):4350-4354. doi:10.1073/pnas.76.9.4350

Engvall E. Perlmann P. Enzyme-linked immunosorbent assay, Elisa. 3. Quantitation of specific antibodies by enzyme-labeled anti-immunoglobulin in antigen-coated tubes. J Immunol. 1972 July; 109(1):129-35. PMID: 4113792.

Elshal M F, McCoy J P. Multiplex bead array assays: performance evaluation and comparison of sensitivity to ELISA. Methods. 2006 April; 38(4):317-23. doi: 10.1016/j.ymeth.2005.11.010. PMID: 16481199; PMCID: PMC1534009.

Shendure J, Porreca G J, Reppas N B, Lin X, McCutcheon J P, Rosenbaum A M, Wang M D, Zhang K, Mitra R D, Church G M. Accurate multiplex polony sequencing of an evolved bacterial genome. Science. 2005 Sep. 9; 309(5741): 1728-32. doi: 10.1126/science.1117389. Epub 2005 Aug. 4. PMID: 16081699.

Trads J B, Tørring T, Gothelf K V. Site-Selective Conjugation of Native Proteins with DNA. Acc Chem Res. 2017 Jun. 20; 50(6):1367-1374. doi: 10.1021/acs.accounts.6b00618. Epub 2017 May 9. PMID: 28485577.

Egloff P, Zimmermann 1, Arnold F M, Hutter C A J, Morger D, Opitz L, Poveda L, Keserue H A, Panse C. Roschitzki B, Seeger M A. Engineered peptide barcodes for in-depth analyses of binding protein libraries. Nat Methods. 2019 May; 16(5):421-428. doi: 10.1038/s41592-019-0389-8. Epub 2019 Apr. 22. PMID: 31011184; PMCID: PMC7116144.

Pollock S B, Hu A, Mou Y, Martinko A J, Julien O, Homsby M. Ploder L, Adams J J, Geng H, Müschen M, Sidhu S S, Moffat J, Wells J A, Highly multiplexed and quantitative cell-surface protein profiling using genetically barcoded antibodies. Proc Natl Acad Sci USA. 2018 Mar. 13; 115(11):2836-2841. doi: 10.1073/pnas.1721899115. Epub 2018 Feb. 23. PMID: 29476010; PMCID: PMC5856557.

Mohan D. Wansley D L, Sie B M, Noon M S, Baer A N, Laserson U, Larman H B. PhIP-Seq characterization of serum antibodies using oligonucleotide-encoded peptidomes. Nat Protoc. 2018 September; 13(9):1958-1978. doi: 10.1038/s41596-018-0025-6. Erratum in: Nat Protoc. 2018 Oct. 25; PMID: 30190553: PMCID: PMC6568263.

Barbas, C. F., Burton, D. R., Scott, J. K., & Silverman, G. J. Phage Display: A Laboratory Manual. 2001. Cold Spring Harbor Laboratory Press.

OTHER EMBODIMENTS

It is to be appreciated by those skilled in the art that various alterations, modifications, and improvements to the present disclosure will readily occur to those skilled in the art. Such alterations, modifications, and improvements are intended to be part of the present disclosure, and are intended to be within the spirit and scope of the invention. Accordingly, the foregoing description and drawing are by way of example only and any invention described in the present disclosure if further described in detail by the claims that follow.

Those skilled in the art will appreciate typical standards of deviation or error attributable to values obtained in assays or other processes as described herein. The publications, websites and other reference materials referenced herein to describe the background of the invention and to provide additional detail regarding its practice, including those listed in the above References section, are hereby incorporated by reference in their entireties.

It is to be understood that while embodiments of the invention have been described in conjunction with the detailed description thereof, the foregoing description is intended to illustrate and not limit the scope of the invention, which is defined by the scope of the appended claims. Other aspects, advantages, and modifications are within the scope of the following claims.

EQUIVALENTS

Those skilled in the art will recognize, or be able to ascertain using no more than routine experimentation, many equivalents to the specific embodiments of the invention described herein. The scope of the present invention is not intended to be limited to the above Description, but rather is as set forth in the following claims:

Lengthy table referenced here

US11976384-20240507-T00001

Please refer to the end of the specification for access instructions.

Lengthy table referenced here

US11976384-20240507-T00002

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11976384B2). An electronic copy of the table will also be available from the USPTO upon request and payment of the fee set forth in 37 CFR 1.19(b)(3).

SEQUENCE LISTING (8562 sequences)

SEQ ID NO: 1 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggacccattagacgagtgggacgcctatctgttcgacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgaggcgtgggagtctgacacccgtattttcggtcaaggtaccaaggtggaaattaaa

SEQ ID NO: 2 - DNA, 729 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcgggttctacgtacgacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcaggtttgggataacaatgtggtttttggtcaaggtaccaaagtggagatcaaa

SEQ ID NO: 3 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcgggttctacgtacgacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcaggtttgggattctagcagcggtgtggttttcggtcagggcaccaaggttgagatcaaa

SEQ ID NO: 4 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcgcacggtggtacgaactctcgcggctggaaagccttagattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggcctgggactctaccaccccgacggttgttttcggccaaggcaccaaagttgagatcaaa

SEQ ID NO: 5 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcgccggttcttctgccgcctctggctttgccacgtggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtggggcgccgcctctggcgtgtttggtcaaggtacgaaagttgaaattaaa

SEQ ID NO: 6 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacgaggtttggatcgccgccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaacctggggcacgggccacgttgtttttggccagggtacgaaggttgaaatcaaa

SEQ ID NO: 7 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgcggtggtgacgttgttaccgcgggtcgcggcttcgattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatataataattggccaccaatcacgtttggtcagggcaccaaggttgagattaaa

SEQ ID NO: 8 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgctgggacttcgactcttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcaggtttgggattctagcagcgacaaaccatacgtttttggccagggtacgaaggttgaaatcaaa

SEQ ID NO: 9 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttagcctacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttctagcgatcattgggttttcggtcaaggcacgaaagtggaaatcaaa

SEQ ID NO: 10 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttagcctacggtagcgcgtctgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttctagcgatcattgggttttcggtcaaggcacgaaagtggaaatcaaa

SEQ ID NO: 11 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttaacgtacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggacggtggtagcgatcattgggttttcggtcaaggcacgaaagtggaaatcaaa

SEQ ID NO: 12 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttaacgtacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggacaacggtagcgatcattgggttttcggtcaaggcacgaaagtggaaatcaaa

SEQ ID NO: 13 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttaacgtacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactctatcagcgatcattgggttttcggtcaaggcacgaaagtggaaatcaaa

SEQ ID NO: 14 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttaacgtacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttctagcgatcattgggttttcggtcaaggcacgaaagtggaaatcaaa

SEQ ID NO: 15 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaacgacatcttaacgtacggtagcgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggacacgaacaccgatcattggttattcggtcaaggcacgaaagtggaaatcaaa

SEQ ID NO: 16 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaaccgctactcttacggtgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtgcggcctgggatgatttaagcggttgggttttcggccagggcacgaaggttgagattaaa

SEQ ID NO: 17 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaatggtcgctcttctgcctacttcaatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccatacacctttggccaaggtacgaaggtggagattaaa

SEQ ID NO: 18 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgaactctaactctccatcttactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccacatgtggaatgccagccgtaaccattgggttttcggtcagggcaccaaggttgagatcaaa

SEQ ID NO: 19 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgaactctaactctccatcttactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccacgtgtgggacagcagcggtgatcactgggttttcggccagggcacgaaggttgagattaaa

SEQ ID NO: 20 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccaacgtttaccaacaaacgtgggcgtttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcatgcagggtgaacgctggccattagcgtttggccaaggtacgaaggtggagattaaa

SEQ ID NO: 21 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcccgcggtgccaacacgtgggactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaagaatattcttttccagttacgtttggccagggtacgaaggttgaaatcaaa

SEQ ID NO: 22 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttccaccgcgcctacggtatggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccaccaacctttggccaaggtacgaaggtggagattaaa

SEQ ID NO: 23 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttctcgcgactacggtgcgggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaacctggggtaacacgcatctggtgttcggtcaaggtaccaaggtggaaattaaa

SEQ ID NO: 24 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccacgcggtgacgccttcgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatcacaccacgccaccaacctttggccaaggtacgaaggtggagattaaa

SEQ ID NO: 25 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttactctggttacggcctgcgctactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatgaccacaacagcgtggtgttcggtcaaggtaccaaggtggaaattaaa

SEQ ID NO: 26 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcacgtctcgcgccgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctggggtgatacgcacttagtgtttggccaaggtacgaaggtggagattaaa

SEQ ID NO: 27 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacacgggtttcggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctacgtggggctttggccaaggtacgaaggtggagattaaa

SEQ ID NO: 28 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacacgtcttctggtgccatggacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtagctcttttggcggtaatgacaacttaatttttggccaaggtacgaaggtggagattaaa

SEQ ID NO: 29 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttcaataccgcttcgacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggccaaaataaacaatttccatggacgttcggccagggcacgaaggttgagattaaa

SEQ ID NO: 30 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactggtggggtgccttcgacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatttaacagcctgggttggattttcggtcaaggcaccaaagttgagatcaaa

SEQ ID NO: 31 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggagggttcttctccgatcacctttggccaaggtacgaaagttgagattaaa

SEQ ID NO: 32 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacgacacgacgccgccactgacctttggtcaaggtaccaaggttgaaatcaaa

SEQ ID NO: 33 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacggttcttctccgatcacctttggccaaggtacgaaagttgagattaaa

SEQ ID NO: 34 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgacttcggtctgggtattatggtgtttggtcaaggtaccaaggttgaaatcaaa

SEQ ID NO: 35 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgacatctctaatttaagccatgtggttttcggtcagggtacgaaagttgaaattaaa

SEQ ID NO: 36 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtggtgactacggtagcggctactacctgccaaattatggcatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcagcagctacacgtcttctagcaaggtgtttggccaaggtacgaaagttgagattaaa

SEQ ID NO: 37 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggggtggttcttggttcggtatggacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatataattctagctctatcacgtttggccagggtacgaaggttgaaatcaaa

SEQ ID NO: 38 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggggtggttcttggttcggtatggacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgattctagcaacgccgtttttggccagggtacgaaggttgaaatcaaa

SEQ ID NO: 39 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggttaggtacgacgggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagcgccccattctatgtgtttggtcaaggtacgaaagttgaaattaaa

SEQ ID NO: 40 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggttaggtacgacgggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagcggtccattaaaagtgtttggtcaaggtacgaaagttgaaattaaa

SEQ ID NO: 41 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtactacggtatcgacgtttggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaagctacgatagctctctgtcttctccaaatgtggtgttcggtcaaggtaccaaggtggaaattaaa

SEQ ID NO: 42 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttcggtgttggttacgacacgcattatatgtacttcgatcactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaattccacagctttccgttaacgttcggtcagggtaccaaagtggagatcaaa

SEQ ID NO: 43 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgacttcttattccgctactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagcacgccgttctacgtttttggccagggtacgaaggttgaaatcaaa

SEQ ID NO: 44 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgactcttctggttgggactactttgatcactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtctaattctccaccaccgattaccttcggtcaaggtaccaaggtggaaattaaa

SEQ ID NO: 45 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggtgcctctatcggtgtttttgatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctggggtaccggtatggttttcggccagggcacgaaggttgagattaaa

SEQ ID NO: 46 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggttctgttgacatcgcctatggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccaactcttttccgctgacgttcggtcaaggcacgaaagtggaaatcaaa

SEQ ID NO: 47 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttaatcatgacgccaggttacctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctggggtaccggtggtttagtgtttggccaaggtacgaaggtggagattaaa

SEQ ID NO: 48 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccaggttactcttacgccgcgatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggactattctttcccaccgacctttggtcaaggtacgaaagttgaaattaaa

SEQ ID NO: 49 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccacgcttcggtgagttaccgtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctaacaccacctggctgttcggtcaaggtaccaaggtggaaattaaa

SEQ ID NO: 50 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctacttagcctcttctagcgcgcacggtggctactatgcgctggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggcctactctccaccgatcagctttggccaaggtacgaaagttgagattaaa

SEQ ID NO: 51 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctacttagcctcttctagcgcgcacggtggctactatgcgctggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggcctactctccaccgatcacctttggccaaggtacgaaagttgagattaaa

SEQ ID NO: 52 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctaccgcaacttatcttatgatgacgacgatttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagcacgggtgttgtttttggtcagggcaccaaggttgagattaaa

SEQ ID NO: 53 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttctgtttctacgggtatcgcgttttactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcagctcttatacgtcttctagcagcctggttttcggtcaaggcacgaaagtggaaatcaaa

SEQ ID NO: 54 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgacttctctacgggtgcctatgattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaaggcgcgcgctggccgttagccttcggccagggcacgaaggttgagattaaa

SEQ ID NO: 55 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaggttacaagggtttcgcctatctgggttcttattctagctatgcgttcgacttatggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagcaatctaactctccgccaattacctttggtcaaggtaccaaggttgaaatcaaa

SEQ ID NO: 56 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttatctggtacgtactactacgcgatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtctgatcgcttaccactgacctttggtcaaggtacgaaagttgaaattaaa

SEQ ID NO: 57 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttataccacacggcctaccgctatacctactactttgacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccacgtttgggacagcagcgatgttgttttcggtcagggtaccaaagtggagatcaaa

SEQ ID NO: 58 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcgctggggtatctaccgcggtaagctgagcgtttacatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagtcttacgacagcagcctgtctggtgttttcggccaaggcaccaaagttgagatcaaa

SEQ ID NO: 59 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgtctcgctacggtgccttcgacctgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatataataactggccgttaacgttcggccagggcacgaaggttgagattaaa

SEQ ID NO: 60 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccaccactctgacttcgaccattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggagtataatgcctatccaacgacgtttggccagggtacgaaggttgaaatcaaa

SEQ ID NO: 61 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccaccactctgacttcgaccattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaaccgtgacgccgccattcacgtttggccagggtacgaaggttgaaatcaaa

SEQ ID NO: 62 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccaccactctgacttcgaccattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatatggctctagcccacgcacgtttggccagggtacgaaggttgaaatcaaa

SEQ ID NO: 63 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccaccactctgacttcgaccattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatattattctaccccacgcacgtttggccagggtacgaaggttgaaatcaaa

SEQ ID NO: 64 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcggtacgggtgacttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggataacggctctgaccacctggtggtgttcggtcaaggtaccaaggtggaaattaaa

SEQ ID NO: 65 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcggtacgggtgacttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccacctggtggtgttcggtcaaggtaccaaggtggaaattaaa

SEQ ID NO: 66 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgacttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttattatctagcagcctggttgttttcggtcagggtaccaaagtggagatcaaa

SEQ ID NO: 67 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgacttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggatacgagcacgtcttctcatgtggtgttcggtcaaggtaccaaggtggaaattaaa

SEQ ID NO: 68 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgacttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagcgcctctccacatgtggtgttcggtcaaggtaccaaggtggaaattaaa

SEQ ID NO: 69 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgacttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgacggtctggtggtgttcggtcaaggtaccaaggtggaaattaaa

SEQ ID NO: 70 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgagttaaaaccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggatacgagcggtaaccacccggtggtgttcggtcaaggtaccaaggtggaaattaaa

SEQ ID NO: 71 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgagttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggatgccagctctgacccatttgtggtgttcggtcaaggtaccaaggtggaaattaaa

SEQ ID NO: 72 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgagttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccaccatgtggtgttcggtcaaggtaccaaggtggaaattaaa

SEQ ID NO: 73 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgagttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctccagttgtggtgtttggtcaaggtacgaaagttgaaattaaa

SEQ ID NO: 74 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactggaacgacttcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcgctatgagagcagcccacgtacgttcggtcagggcaccaaggttgagatcaaa

SEQ ID NO: 75 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtccattaccaaacgttggttacggcatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttattactgagctatgttttcggtcaaggcacgaaagtggaaatcaaa

SEQ ID NO: 76 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaaggttggttagccacgacgcgcggcatggatttatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgggtgatcgcacgacgggccagtttggtcaaggtacgaaagttgaaattaaa

SEQ ID NO: 77 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaaaagttacgcggtgacggttttgatacgtggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcattacggcggtccattcacctttggccaaggtacgaaggtggagattaaa

SEQ ID NO: 78 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctggtaactcttacggtcaatttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctggggtaccggtcacgttgtgtttggccaaggtacgaaggtggagattaaa

SEQ ID NO: 79 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctggtcaatacggtggttactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggagtattctttcccagtgacctttggtcaaggtacgaaagttgaaattaaa

SEQ ID NO: 80 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggccgcctacgttttaggtcattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctattccattcacgtttggccagggtacgaaggttgaaatcaaa

SEQ ID NO: 81 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggccgcctacgttttaggtcattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctattccattaacgtttggccagggtacgaaggttgaaatcaaa

SEQ ID NO: 82 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgcatcggttactctcaccatgcggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgctattcttatgttggttctagcacctgggtgttcggtcaaggtaccaaggtggaaattaaa

SEQ ID NO: 83 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtgccgccgccttcgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtaccctggacagcatcttacgcagctgggtgtttggtcaaggtacgaaagttgaaattaaa

SEQ ID NO: 84 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccatctcttttccgctgacgttcggtcaaggcacgaaagtggaaatcaaa

SEQ ID NO: 85 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccaactcttttccgattacgttcggtcaaggcacgaaagtggaaatcaaa

SEQ ID NO: 86 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccaactcttttccgctgacgttcggtcaaggcacgaaagtggaaatcaaa

SEQ ID NO: 87 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccaactcttttccgccgacgttcggtcaaggcacgaaagtggaaatcaaa

SEQ ID NO: 88 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggcctactcttttccgccgacgttcggtcaaggcacgaaagtggaaatcaaa

SEQ ID NO: 89 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagggtatcaactggccgctgaccttcggtcaaggtaccaaggtggaaattaaa

SEQ ID NO: 90 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaacctggggttctggtattgtgtttggtcaaggtacgaaagttgaaattaaa

SEQ ID NO: 91 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttggaacatcgccatcgttggtgccgcgccggttccagtgatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagccaatagctttccattaacgttcggccaaggcaccaaagttgagatcaaa

SEQ ID NO: 92 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttggaacatcgccatcgttggtgccgcgccggttccagtgatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagccaatagctttccagtttctttcggccaaggcaccaaagttgagatcaaa

SEQ ID NO: 93 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttggaacatcgccatcgttggtgccgcgccggttccagtgatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagccaatagctttccagttacgttcggccaaggcaccaaagttgagatcaaa

SEQ ID NO: 94 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttacggttctaactaccgctactttgatcgctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtatgcagggctctcattggccatgggccttcggccagggcacgaaggttgagattaaa

SEQ ID NO: 95 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgccggtccagacgacgacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacgggtgttgtgtttggccaaggtacgaaggtggagattaaa

SEQ ID NO: 96 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgccggtccagacgacgacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagcacggttttcggccagggcacgaaggttgagattaaa

SEQ ID NO: 97 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcccaaagtacggtgacttctactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcactatgccatcccactgacctttggtcaaggtacgaaagttgaaattaaa

SEQ ID NO: 98 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccaacgactggtggggtcactggggtcaatggggtcagggcacgttagtgacggtgagcagcggtggttctagccgtagcagctcttctggtggtggtggctctggtggcggcggcgagattgtgttaacccagagcccagcgaccttaagcctgagcccgggcgaacgtgcgacgttaagctgtcgcgcgagccagtctgtgtcttcttcttatttagcctggtaccagcaaaaaccaggccaagcgccgcgcttactgatctatggtgccagcagccgtgccaccggtatcccagcgcgcttctctggtagcggcagcggtaccgattttacgctgaccatttctcgcctggaaccggaggactttgcggtttactactgccaagtttgggattctcagtctaatagctgggtttttggtcaaggtaccaaagtggagatcaaa

SEQ ID NO: 99 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccacctacgacgttttaacgggtttcgaatattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaacctggggcacgggcatccgcgtttttggccagggtacgaaggttgaaatcaaa

SEQ ID NO: 100 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccacctacttaggtggtatcgttggtgcgagcgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagaatacacggccccggtgaccttcggtcaaggtaccaaggtggaaattaaa

SEQ ID NO: 101 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctggcggtgagttagcccgcggtttcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagcgttaccatcccacgcacctttggccaaggtacgaaggtggagattaaa

SEQ ID NO: 102 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcactctggttggttattcccatctgcgtttgacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagaactggggcacgggtgttggcggctttggtcaaggtacgaaagttgaaattaaa

SEQ ID NO: 103 - DNA, 753 bp, Artificial Sequence; identical to SEQ ID NO: 1
  Description of Artificial Sequence: Synthetic polynucleotide

SEQ ID NO: 104 - DNA, 729 bp, Artificial Sequence; identical to SEQ ID NO: 2
  Description of Artificial Sequence: Synthetic polynucleotide

SEQ ID NO: 105 - DNA, 735 bp, Artificial Sequence; identical to SEQ ID NO: 3
  Description of Artificial Sequence: Synthetic polynucleotide

SEQ ID NO: 106 - DNA, 762 bp, Artificial Sequence; identical to SEQ ID NO: 4
  Description of Artificial Sequence: Synthetic polynucleotide

SEQ ID NO: 107 - DNA, 747 bp, Artificial Sequence; identical to SEQ ID NO: 5
  Description of Artificial Sequence: Synthetic polynucleotide

SEQ ID NO: 108 - DNA, 744 bp, Artificial Sequence; identical to SEQ ID NO: 6
  Description of Artificial Sequence: Synthetic polynucleotide

SEQ ID NO: 109 - DNA, 762 bp, Artificial Sequence; identical to SEQ ID NO: 7
  Description of Artificial Sequence: Synthetic polynucleotide

SEQ ID NO: 110 - DNA, 744 bp, Artificial Sequence; identical to SEQ ID NO: 8
  Description of Artificial Sequence: Synthetic polynucleotide

SEQ ID NO: 111 - DNA, 756 bp, Artificial Sequence; identical to SEQ ID NO: 9
  Description of Artificial Sequence: Synthetic polynucleotide

SEQ ID NO: 112 - DNA, 756 bp, Artificial Sequence; identical to SEQ ID NO: 10
  Description of Artificial Sequence: Synthetic polynucleotide

SEQ ID NO: 113 - DNA, 756 bp, Artificial Sequence; identical to SEQ ID NO: 11
  Description of Artificial Sequence: Synthetic polynucleotide

SEQ ID NO: 114 - DNA, 756 bp, Artificial Sequence; identical to SEQ ID NO: 12
  Description of Artificial Sequence: Synthetic polynucleotide

SEQ ID NO: 115 - DNA, 756 bp, Artificial Sequence; identical to SEQ ID NO: 13
  Description of Artificial Sequence: Synthetic polynucleotide

SEQ ID NO: 116 - DNA, 756 bp, Artificial Sequence; identical to SEQ ID NO: 14
  Description of Artificial Sequence: Synthetic polynucleotide

SEQ ID NO: 117 - DNA, 756 bp, Artificial Sequence; identical to SEQ ID NO: 15
  Description of Artificial Sequence: Synthetic polynucleotide

SEQ ID NO: 118 - DNA, 741 bp, Artificial Sequence; identical to SEQ ID NO: 16
  Description of Artificial Sequence: Synthetic polynucleotide

SEQ ID NO: 119 - DNA, 741 bp, Artificial Sequence; identical to SEQ ID NO: 17
  Description of Artificial Sequence: Synthetic polynucleotide

SEQ ID NO: 120 - DNA, 741 bp, Artificial Sequence; identical to SEQ ID NO: 18
  Description of Artificial Sequence: Synthetic polynucleotide

SEQ ID NO: 121 - DNA, 741 bp, Artificial Sequence; identical to SEQ ID NO: 19
  Description of Artificial Sequence: Synthetic polynucleotide

SEQ ID NO: 122 - DNA, 750 bp, Artificial Sequence; identical to SEQ ID NO: 20
  Description of Artificial Sequence: Synthetic polynucleotide

SEQ ID NO: 123 - DNA, 741 bp, Artificial Sequence; identical to SEQ ID NO: 21
  Description of Artificial Sequence: Synthetic polynucleotide

SEQ ID NO: 124 - DNA, 744 bp, Artificial Sequence; identical to SEQ ID NO: 22
  Description of Artificial Sequence: Synthetic polynucleotide

SEQ ID NO: 125 - DNA, 750 bp, Artificial Sequence; identical to SEQ ID NO: 23
  Description of Artificial Sequence: Synthetic polynucleotide

SEQ ID NO: 126 - DNA, 741 bp, Artificial Sequence; identical to SEQ ID NO: 24
  Description of Artificial Sequence: Synthetic polynucleotide

SEQ ID NO: 127 - DNA, 744 bp, Artificial Sequence; identical to SEQ ID NO: 26
  Description of Artificial Sequence: Synthetic polynucleotide

SEQ ID NO: 128 - DNA, 744 bp, Artificial Sequence; identical to SEQ ID NO: 27
  Description of Artificial Sequence: Synthetic polynucleotide

SEQ ID NO: 129 - DNA, 744 bp, Artificial Sequence; identical to SEQ ID NO: 28
  Description of Artificial Sequence: Synthetic polynucleotide

SEQ ID NO: 130 - DNA, 738 bp, Artificial Sequence; identical to SEQ ID NO: 29
  Description of Artificial Sequence: Synthetic polynucleotide

SEQ ID NO: 131 - DNA, 771 bp, Artificial Sequence; identical to SEQ ID NO: 31
  Description of Artificial Sequence: Synthetic polynucleotide

SEQ ID NO: 132 - DNA, 774 bp, Artificial Sequence; identical to SEQ ID NO: 32
  Description of Artificial Sequence: Synthetic polynucleotide

SEQ ID NO: 133 - DNA, 771 bp, Artificial Sequence; identical to SEQ ID NO: 33
  Description of Artificial Sequence: Synthetic polynucleotide

SEQ ID NO: 134 - DNA, 777 bp, Artificial Sequence; identical to SEQ ID NO: 34
  Description of Artificial Sequence: Synthetic polynucleotide

SEQ ID NO: 135 - DNA, 780 bp, Artificial Sequence; identical to SEQ ID NO: 35
  Description of Artificial Sequence: Synthetic polynucleotide

SEQ ID NO: 136 - DNA, 771 bp, Artificial Sequence; identical to SEQ ID NO: 36
  Description of Artificial Sequence: Synthetic polynucleotide

SEQ ID NO: 137 - DNA, 747 bp, Artificial Sequence; identical to SEQ ID NO: 37
  Description of Artificial Sequence: Synthetic polynucleotide

SEQ ID NO: 138 - DNA, 747 bp, Artificial Sequence; identical to SEQ ID NO: 38
  Description of Artificial Sequence: Synthetic polynucleotide

SEQ ID NO: 139 - DNA, 753 bp, Artificial Sequence; identical to SEQ ID NO: 39
  Description of Artificial Sequence: Synthetic polynucleotide

SEQ ID NO: 140 - DNA, 753 bp, Artificial Sequence; identical to SEQ ID NO: 40
  Description of Artificial Sequence: Synthetic polynucleotide

SEQ ID NO: 141 - DNA, 747 bp, Artificial Sequence; identical to SEQ ID NO: 41
  Description of Artificial Sequence: Synthetic polynucleotide

SEQ ID NO: 142 - DNA, 756 bp, Artificial Sequence; identical to SEQ ID NO: 42
  Description of Artificial Sequence: Synthetic polynucleotide

SEQ ID NO: 143 - DNA, 741 bp, Artificial Sequence; identical to SEQ ID NO: 43
  Description of Artificial Sequence: Synthetic polynucleotide

SEQ ID NO: 144 - DNA, 750 bp, Artificial Sequence; identical to SEQ ID NO: 44
  Description of Artificial Sequence: Synthetic polynucleotide

SEQ ID NO: 145 - DNA, 741 bp, Artificial Sequence; identical to SEQ ID NO: 45
  Description of Artificial Sequence: Synthetic polynucleotide

SEQ ID NO: 146 - DNA, 747 bp, Artificial Sequence; identical to SEQ ID NO: 47
  Description of Artificial Sequence: Synthetic polynucleotide

SEQ ID NO: 147 - DNA, 747 bp, Artificial Sequence; identical to SEQ ID NO: 48
  Description of Artificial Sequence: Synthetic polynucleotide

SEQ ID NO: 148 - DNA, 750 bp, Artificial Sequence; identical to SEQ ID NO: 49
  Description of Artificial Sequence: Synthetic polynucleotide

SEQ ID NO: 149 - DNA, 768 bp, Artificial Sequence; identical to SEQ ID NO: 50
  Description of Artificial Sequence: Synthetic polynucleotide

SEQ ID NO: 150 - DNA, 768 bp, Artificial Sequence; identical to SEQ ID NO: 51
  Description of Artificial Sequence: Synthetic polynucleotide

SEQ ID NO: 151 - DNA, 762 bp, Artificial Sequence; identical to SEQ ID NO: 52
  Description of Artificial Sequence: Synthetic polynucleotide

SEQ ID NO: 152 - DNA, 750 bp, Artificial Sequence; identical to SEQ ID NO: 53
  Description of Artificial Sequence: Synthetic polynucleotide

SEQ ID NO: 153 - DNA, 741 bp, Artificial Sequence; identical to SEQ ID NO: 54
  Description of Artificial Sequence: Synthetic polynucleotide

SEQ ID NO: 154 - DNA, 771 bp, Artificial Sequence; identical to SEQ ID NO: 55
  Description of Artificial Sequence: Synthetic polynucleotide

SEQ ID NO: 155 - DNA, 747 bp, Artificial Sequence; identical to SEQ ID NO: 56
  Description of Artificial Sequence: Synthetic polynucleotide

SEQ ID NO: 156 - DNA, 756 bp, Artificial Sequence; identical to SEQ ID NO: 57
  Description of Artificial Sequence: Synthetic polynucleotide

SEQ ID NO: 157 - DNA, 765 bp, Artificial Sequence; identical to SEQ ID NO: 58
  Description of Artificial Sequence: Synthetic polynucleotide

SEQ ID NO: 158 - DNA, 741 bp, Artificial Sequence; identical to SEQ ID NO: 59
  Description of Artificial Sequence: Synthetic polynucleotide

SEQ ID NO: 159 - DNA, 738 bp, Artificial Sequence; identical to SEQ ID NO: 60
  Description of Artificial Sequence: Synthetic polynucleotide

SEQ ID NO: 160 - DNA, 738 bp, Artificial Sequence; identical to SEQ ID NO: 61
  Description of Artificial Sequence: Synthetic polynucleotide

SEQ ID NO: 161 - DNA, 738 bp, Artificial Sequence; identical to SEQ ID NO: 62
  Description of Artificial Sequence: Synthetic polynucleotide

SEQ ID NO: 162 - DNA, 738 bp, Artificial Sequence; identical to SEQ ID NO: 63
  Description of Artificial Sequence: Synthetic polynucleotide

SEQ ID NO: 163 - DNA, 750 bp, Artificial Sequence; identical to SEQ ID NO: 64
  Description of Artificial Sequence: Synthetic polynucleotide

SEQ ID NO: 164 - DNA, 750 bp, Artificial Sequence; identical to SEQ ID NO: 65
  Description of Artificial Sequence: Synthetic polynucleotide

SEQ ID NO: 165 - DNA, 756 bp, Artificial Sequence; identical to SEQ ID NO: 66
  Description of Artificial Sequence: Synthetic polynucleotide

SEQ ID NO: 166 - DNA, 750 bp, Artificial Sequence; identical to SEQ ID NO: 67
  Description of Artificial Sequence: Synthetic polynucleotide

SEQ ID NO: 167 - DNA, 750 bp, Artificial Sequence; identical to SEQ ID NO: 68
  Description of Artificial Sequence: Synthetic polynucleotide

SEQ ID NO: 168 - DNA, 750 bp, Artificial Sequence; identical to SEQ ID NO: 69
  Description of Artificial Sequence: Synthetic polynucleotide

SEQ ID NO: 169 - DNA, 750 bp, Artificial Sequence; identical to SEQ ID NO: 70
  Description of Artificial Sequence: Synthetic polynucleotide

SEQ ID NO: 170 - DNA, 750 bp, Artificial Sequence; identical to SEQ ID NO: 71
  Description of Artificial Sequence: Synthetic polynucleotide

SEQ ID NO: 171 - DNA, 750 bp, Artificial Sequence; identical to SEQ ID NO: 72
  Description of Artificial Sequence: Synthetic polynucleotide

SEQ ID NO: 172 - DNA, 747 bp, Artificial Sequence; identical to SEQ ID NO: 73
  Description of Artificial Sequence: Synthetic polynucleotide

SEQ ID NO: 173 - DNA, 735 bp, Artificial Sequence; identical to SEQ ID NO: 74
  Description of Artificial Sequence: Synthetic polynucleotide

SEQ ID NO: 174 - DNA, 756 bp, Artificial Sequence; identical to SEQ ID NO: 75
  Description of Artificial Sequence: Synthetic polynucleotide

SEQ ID NO: 175 - DNA, 750 bp, Artificial Sequence; identical to SEQ ID NO: 76
  Description of Artificial Sequence: Synthetic polynucleotide

SEQ ID NO: 176 - DNA, 741 bp, Artificial Sequence; identical to SEQ ID NO: 77
  Description of Artificial Sequence: Synthetic polynucleotide

SEQ ID NO: 177 - DNA, 744 bp, Artificial Sequence; identical to SEQ ID NO: 79
  Description of Artificial Sequence: Synthetic polynucleotide

SEQ ID NO: 178 - DNA, 738 bp, Artificial Sequence; identical to SEQ ID NO: 80
  Description of Artificial Sequence: Synthetic polynucleotide

SEQ ID NO: 179 - DNA, 738 bp, Artificial Sequence; identical to SEQ ID NO: 81
  Description of Artificial Sequence: Synthetic polynucleotide

SEQ ID NO: 180 - DNA, 750 bp, Artificial Sequence; identical to SEQ ID NO: 82
  Description of Artificial Sequence: Synthetic polynucleotide

SEQ ID NO: 181 - DNA, 750 bp, Artificial Sequence; identical to SEQ ID NO: 84
  Description of Artificial Sequence: Synthetic polynucleotide

SEQ ID NO: 182 - DNA, 750 bp, Artificial Sequence; identical to SEQ ID NO: 85
  Description of Artificial Sequence: Synthetic polynucleotide

SEQ ID NO: 183 - DNA, 750 bp, Artificial Sequence; identical to SEQ ID NO: 86
  Description of Artificial Sequence: Synthetic polynucleotide

SEQ ID NO: 184 - DNA, 750 bp, Artificial Sequence; identical to SEQ ID NO: 87
  Description of Artificial Sequence: Synthetic polynucleotide

SEQ ID NO: 185 - DNA, 750 bp, Artificial Sequence; identical to SEQ ID NO: 88
  Description of Artificial Sequence: Synthetic polynucleotide

SEQ ID NO: 186 - DNA, 750 bp, Artificial Sequence; identical to SEQ ID NO: 89
  Description of Artificial Sequence: Synthetic polynucleotide

SEQ ID NO: 187 - DNA, 747 bp, Artificial Sequence; identical to SEQ ID NO: 90
  Description of Artificial Sequence: Synthetic polynucleotide

SEQ ID NO: 188 - DNA, 762 bp, Artificial Sequence; identical to SEQ ID NO: 91
  Description of Artificial Sequence: Synthetic polynucleotide

SEQ ID NO: 189 - DNA, 762 bp, Artificial Sequence; identical to SEQ ID NO: 92
  Description of Artificial Sequence: Synthetic polynucleotide

SEQ ID NO: 190 - DNA, 762 bp, Artificial Sequence; identical to SEQ ID NO: 93
  Description of Artificial Sequence: Synthetic polynucleotide

SEQ ID NO: 191 - DNA, 744 bp, Artificial Sequence; identical to SEQ ID NO: 94
  Description of Artificial Sequence: Synthetic polynucleotide

SEQ ID NO: 192 - DNA, 744 bp, Artificial Sequence; identical to SEQ ID NO: 95
  Description of Artificial Sequence: Synthetic polynucleotide

SEQ ID NO: 193 - DNA, 738 bp, Artificial Sequence; identical to SEQ ID NO: 96
  Description of Artificial Sequence: Synthetic polynucleotide

SEQ ID NO: 194 - DNA, 744 bp, Artificial Sequence; identical to SEQ ID NO: 97
  Description of Artificial Sequence: Synthetic polynucleotide

SEQ ID NO: 195 - DNA, 738 bp, Artificial Sequence; identical to SEQ ID NO: 98
  Description of Artificial Sequence: Synthetic polynucleotide

SEQ ID NO: 196 - DNA, 747 bp, Artificial Sequence; identical to SEQ ID NO: 100
  Description of Artificial Sequence: Synthetic polynucleotide

SEQ ID NO: 197 - DNA, 750 bp, Artificial Sequence; identical to SEQ ID NO: 102
  Description of Artificial Sequence: Synthetic polynucleotide

SEQ ID NO: 198 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggccaagaacggtgcctctttaggcgtgaacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatgactcttctctgagcggctctccagttgtttttggtcagggcaccaaggttgagattaaa

SEQ ID NO: 199 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtgccgcgtgggacaattctctgagcgccgtggttttcggtcagggcaccaaggttgagatcaaa

SEQ ID NO: 200 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtttaagctgggacagctctctgagcgccgaagttttcggtcagggcaccaaggttgagatcaaa

SEQ ID NO: 201 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagcgtgggacagctctacccgtggtgtgttcggtcaaggcaccaaagttgagatcaaa

SEQ ID NO: 202 - DNA, 729 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaacagtactattctgtgccgtggacgtttggtcaaggtaccaaagtggagatcaaa

SEQ ID NO: 203 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaaagctgggacgcgggtaccaatcgcgtgttcggtcaaggcaccaaagttgagatcaaa

SEQ ID NO: 204 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagtgtgggacagctctagcgatcacccggttttcggtcagggcaccaaggttgagatcaaa

SEQ ID NO: 205 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgataacggtccagactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagtgtgggacagctctagcgatcactgggtgttcggtcaaggcaccaaagttgagatcaaa

SEQ ID NO: 206 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatacggcctactctttaccagttgatttttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacattatgacaattggccaccaacgtttggccagggtacgaaggttgaaatcaaa

SEQ ID NO: 207 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcgactcttcttcttctatgccatactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggacggcacgccaccacgtacctttggtcaaggtacgaaagttgaaattaaa

SEQ ID NO: 208 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcggtggtaactacggtcaattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcggacagcccaccaatcacctttggccaaggtacgaaggtggagattaaa

SEQ ID NO: 209 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcggtggtaactacggtcaattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcccaccaatcacctttggccaaggtacgaaggtggagattaaa

SEQ ID NO: 210 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcggtggtaactacggtcaattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaccaatcacctttggccaaggtacgaaggtggagattaaa

SEQ ID NO: 211 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcgttggtcgcatcttcccatactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtcttatagcacgccgttcacgttcggccagggcacgaaggttgagattaaa

SEQ ID NO: 212 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcgttggtcgcatcttcccatactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagacgtatatgaccccactgacgttcggtcagggcaccaaggttgagatcaaa

SEQ ID NO: 213 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccatcgcttagccaactacacgcgcgtggatcgctactatgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttggcacagcggcgataaccgctgggttttcggccaaggcaccaaagttgagatcaaa

SEQ ID NO: 214 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccattctcgctctatctctccatactattttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataactcttactatagcggcgccttcggtcaaggcacgaaagtggaaatcaaa

SEQ ID NO: 215 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccttatacggtggtttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctaccacgttcacgtttggccagggtacgaaggttgaaatcaaa

SEQ ID NO: 216 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccccattctggccacgctcttacacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttctcatcatagccgcgttttcggtcagggtaccaaagtggagatcaaa

SEQ ID NO: 217 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccgttgccttaggttgggccttcgatcgttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttatctgccggcgtgtttggtcaaggtacgaaagttgaaattaaa

SEQ ID NO: 218 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacgccccatctggttacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataacaattggccacgcacgtttggccagggtacgaaggttgaaatcaaa

SEQ ID NO: 219 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttccgcggtggtggttcttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgataacttattatggacctttggccaaggtacgaaggtggagattaaa

SEQ ID NO: 220 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttccgcggtggtggttcttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaattcttacttatggacctttggccaaggtacgaaggtggagattaaa

SEQ ID NO: 221 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtgccgttacgtacggtgcgctgggtgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggacatctctagcacctatgttttcggtcaaggcacgaaagtggaaatcaaa

SEQ ID NO: 222 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtgccgttaacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaaccagcggtacccaagttgtttttggccagggtacgaaggttgaaatcaaa

SEQ ID NO: 223 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtctgctgtcttattcttctgttcgtgtgtttggtcaaggtacgaaagttgaaattaaa

SEQ ID NO: 224 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacggctcttctccagcgtggacctttggtcaaggtacgaaagttgaaattaaa

SEQ ID NO: 225 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattctggtttacgtggcaaagttttcggtcaaggcacgaaagtggaaatcaaa

SEQ ID NO: 226 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctcgcagcggctatgttttcggtcaaggcacgaaagtggaaatcaaa

SEQ ID NO: 227 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacaattcttctgacccgcattatgttttcggtcaaggcacgaaagtggaaatcaaa

SEQ ID NO: 228 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtttataccgctacttttattactacaaagttggcgatgcgttcgactactggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagtctgccgactctagcggtacctatccgtgggttttcggtcagggtacgaaagttgaaattaaa

SEQ ID NO: 229 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccgcctgggatgatagcttaatcgacccagtgttcggccagggcacgaaggttgaaatcaaa

SEQ ID NO: 230 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccgcctgggatgatagcttaaacgccgttgtgttcggccagggcacgaaggttgaaatcaaa

SEQ ID NO: 231 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccgcctgggatgatagcccaaacggtcgcgtgttcggccagggcacgaaggttgaaatcaaa

SEQ ID NO: 232 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccggttgggatgatagcttatctggttgggtttttggtcagggcaccaaggttgagattaaa

SEQ ID NO: 233 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgcctcttgggatgatagcttaaacggtcgcgtgttcggccagggcacgaaggttgaaatcaaa

SEQ ID NO: 234 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtggtgtttgggatagcagcgttggtggttgggtttttggtcagggcaccaaggttgagattaaa

SEQ ID NO: 235 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcaatacggccgttttcggccaaggcaccaaagttgagatcaaa

SEQ ID NO: 236 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagctatagcccaccaccaacgtttggtcagggcaccaaggttgagattaaa

SEQ ID NO: 237 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctctttattaccaggcgttgtgtttggccaaggtacgaaagttgagattaaa

SEQ ID NO: 238 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaaacgtgggatagctttggtcaagttttcggccaaggcaccaaagttgagatcaaa

SEQ ID NO: 239 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcgctctgccgccatcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttcttctctggtggtgttcggtcaaggtaccaaggtggaaattaaa

SEQ ID NO: 240 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccactctgcctaccgcggtggcttttactcttatacgtttgattattggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaagcgtgggatagcacggaccacgttgtgttcggccagggcacgaaggttgaaatcaaa

SEQ ID NO: 241 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagccgcggttctggcgtgtttggtcaaggtacgaaagttgaaattaaa

SEQ ID NO: 242 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatggtagccgctctccagtgtggagctttggtcaaggtacgaaagttgaaattaaa

SEQ ID NO: 243 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctctgtattacggcggtggtgaccgtctgtttggtcaaggtacgaaagttgaaattaaa

SEQ ID NO: 244 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacatctggtactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaagctgggccaaaagcggtggcaaccgcgtttttggccagggtacgaaggttgaaatcaaa

SEQ ID NO: 245 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaggtacgggtttcatgcaaggctattgggccttagattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtaattctcgcgacagccgtggcaacaacttatgggtttttggtcagggcaccaaggttgagattaaa

SEQ ID NO: 246 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatcggttcttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaacctgggatatcggcacgtacgttgtgtttggccaaggtacgaaggtggagattaaa

SEQ ID NO: 247 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcccattagttgtgtttggccaaggtacgaaggtggagattaaa

SEQ ID NO: 248 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctacctctttagttgtgtttggccaaggtacgaaggtggagattaaa

SEQ ID NO: 249 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacattttggtagctctccaaagctgacctttggtcaaggtacgaaagttgaaattaaa

SEQ ID NO: 250 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaccaccaacctttggccaaggtacgaaggtggagattaaa

SEQ ID NO: 251 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataacagcttcccattaacctttggccaaggtacgaaggtggagattaaa

SEQ ID NO: 252 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagctatgacagctctttatctggcgtggtgttcggtcaaggtaccaaggtggaaattaaa

SEQ ID NO: 253 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagctatgacagctctttatctagcctggtggttttcggtcaaggcacgaaagtggaaatcaaa

SEQ ID NO: 254 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaacctgggattcttttggtcaagtttttggccagggtacgaaggttgaaatcaaa

SEQ ID NO: 255 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccaaggcgtgtttggtcaaggtacgaaagttgaaattaaa

SEQ ID NO: 256 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaccaggtacgatgtctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccatggacgttcggccagggcacgaaggttgagattaaa

SEQ ID NO: 257 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgcttctctggtgtttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggaccgttcttctgaccagtatgtgttcggtcaaggtaccaaggtggaaattaaa

SEQ ID NO: 258 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgctggaacaacgttaacaatgattcttacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcggcgccgttgttttcggccaaggcaccaaagttgagatcaaa

SEQ ID NO: 259 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgaaaccggtgattctaacaacctggtggtgttcggtcaaggtaccaaggtggaaattaaa

SEQ ID NO: 260 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctcttctccatatgtggtgttcggtcaaggtaccaaggtggaaattaaa

SEQ ID NO: 261 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacacctctacgtgggtttttggccagggtacgaaggttgaaatcaaa

SEQ ID NO: 262 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcgcaaaaacaacccacgtacctttggtcaaggtacgaaagttgaaattaaa

SEQ ID NO: 263 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcgcagcaactggccaccactgacctttggtcaaggtacgaaagttgaaattaaa

SEQ ID NO: 264 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtctagctctttctctccgtataccttcggtcaaggtaccaaggtggaaattaaa

SEQ ID NO: 265 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctccaccaattacctttggtcaaggtacgaaagttgaaattaaa

SEQ ID NO: 266 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctccaccaccgacctttggtcaaggtacgaaagttgaaattaaa

SEQ ID NO: 267 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctacgttatatacctttggtcaaggtacgaaagttgaaattaaa

SEQ ID NO: 268 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgattctacgttatggacctttggccaaggtacgaaggtggagattaaa

SEQ ID NO: 269 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacggctcttctccactgattagcttcggtcaaggtaccaaggtggaaattaaa

SEQ ID NO: 270 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaatggtttacgcacctttggccaaggtacgaaggtggagattaaa

SEQ ID NO: 271 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaattctttcccactgacctttggtcaaggtacgaaagttgaaattaaa

SEQ ID NO: 272 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtcaagtgtttggccaaggtacgaaggtggagattaaa

SEQ ID NO: 273 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctctgactctgatcatgtggttttcggtcaaggcacgaaagtggaaatcaaa

SEQ ID NO: 274 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctggtgatcaggtgttcggtcaaggtaccaaggtggaaattaaa

SEQ ID NO: 275 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagtattacggctcttacccactgtatgcgttcggtcaaggtaccaaggtggaaattaaa

SEQ ID NO: 276 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacagcggttcttctaccttttgggtgttcggtcaaggtaccaaggtggaaattaaa

SEQ ID NO: 277 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttagttacgggttctttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacattacgccatggacgtttggccagggtacgaaggttgaaatcaaa

SEQ ID NO: 278 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttagttgttggtgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccatggacgtttggccagggtacgaaggttgaaatcaaa

SEQ ID NO: 279 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttagttgttggtgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcataagagctacccacactttacctttggtcaaggtacgaaagttgaaattaaa

SEQ ID NO: 280 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttagttgttggtgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataagagccactctacgtttggccagggtacgaaggttgaaatcaaa

SEQ ID NO: 281 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttatacgccatctctttatttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagccgcacgtgggtttttggccagggtacgaaggttgaaatcaaa

SEQ ID NO: 282 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccaagagggttaccgcgcctatggctacaacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgtctggtaactgggtttttggtcagggcaccaaggttgagattaaa

SEQ ID NO: 283 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccaagagggttaccgcgcctatggctacaacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcatgcaaggtgcccattggccgtgggcgttcggtcaaggtaccaaggtggaaattaaa

SEQ ID NO: 284 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgccgccacacgcgcggtacctggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtacctcttatacctctagctctgagttatatgcgtttggtcaaggtacgaaagttgaaattaaa

SEQ ID NO: 285 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgctctgttgttccaacgtattatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagcgctctaactggccgccgagcttcggtcaaggtaccaaggtggaaattaaa

SEQ ID NO: 286 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactctggtacgcacggtacgtttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcaccttagattctatcttacgtagctgggtgttcggtcaaggtaccaaggtggaaattaaa

SEQ ID NO: 287 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgaggagtgggacgatagcctgaagggtcaagtttttggtcagggcaccaaggttgagattaaa

SEQ ID NO: 288 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgttaggtgccggtgtgttcggccagggcacgaaggttgaaatcaaa

SEQ ID NO: 289 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgcgcgccgttgtttttggtcagggcaccaaggttgagattaaa

SEQ ID NO: 290 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtgtttgggacagcagcggcgccgttgttgtttttggtcagggcaccaaggttgagattaaa

SEQ ID NO: 291 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcttacaacacaatagctatccatggacgttcggtcagggtaccaaagtggagatcaaa

SEQ ID NO: 292 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcagcgaccacgttgtttttggtcagggcaccaaggttgagattaaa

SEQ ID NO: 293 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcacctctcacgttgtttttggtcagggcaccaaggttgagattaaa

SEQ ID NO: 294 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgatagcaatccatactctttcggccaaggcaccaaagttgagatcaaa

SEQ ID NO: 295 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaccaacgttcggccaaggcaccaaagttgagatcaaa

SEQ ID NO: 296 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatacggcagcagcccacgcacgttcggccaaggcaccaaagttgagatcaaa

SEQ ID NO: 297 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatacaaacgtccgttaacgttcggtcagggtaccaaagtggagatcaaa

SEQ ID NO: 298 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcagctcttctttaccagtggtttttggccagggtacgaaggtggagatcaaa

SEQ ID NO: 299 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagatgtactggcaatcttacttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtaatgcctgggatagcacgctgcgccaagttgtgtttggccaaggtacgaaggtggagattaaa

SEQ ID NO: 300 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagcgccgctacgccggtcacagcgtggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctttaagcggcctgtcttacgttttcggccaaggcaccaaagttgagatcaaa

SEQ ID NO: 301 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagtctgtttctggttctcgcctgggctggttcgacccgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttctagcgatggctacgttttcggtcagggtaccaaagtggagatcaaa

SEQ ID NO: 302 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacggccagcgtggtgttcggtcaaggtaccaaggtggaaattaaa

SEQ ID NO: 303 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagctgtggggtaccggtggtgacctggtgtttggtcaaggtacgaaagttgaaattaaa

SEQ ID NO: 304 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacagctcttcttctagcattgcgtggatcttcggtcaaggcacgaaagtggaaatcaaa

SEQ ID NO: 305 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaattcaacccagttggtggtttcgatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttattatctgcgtgggtgtttggtcaaggtacgaaagttgaaattaaa

SEQ ID NO: 306 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtggttgggcctacatcttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagctcttctgccgtgtttggccaaggtacgaaggtggagattaaa

SEQ ID NO: 307 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtggttacggtcactctggttatgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtaccttagactctagcctgagcttatgggttttcggtcagggtaccaaagtggagatcaaa

SEQ ID NO: 308 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcactcttctacgtacgttattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacgacgggctatgtgttcggtcaaggtaccaaggtggaaattaaa

SEQ ID NO: 309 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtatcccattacaatacacgtatggcaacgaccgttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtaccaccactggccgctgaccttcggtcaaggtaccaaggtggaaattaaa

SEQ ID NO: 310 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttatcttgggccggttcttacggctatgttatcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatactacagcaccccgccagccacgttcggccaaggcaccaaagttgagatcaaa

SEQ ID NO: 311 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttatggggtgccttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagccgtacgccgtacgttttcggccagggcacgaaggttgagattaaa

SEQ ID NO: 312 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggctcttatggctctacctctggtttatatgtgtttggtcaaggtacgaaagttgaaattaaa

SEQ ID NO: 313 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagctctagcttagttgtttttggccagggtacgaaggttgaaatcaaa

SEQ ID NO: 314 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgattctagcttatcttctctggtggtgttcggtcaaggtaccaaggtggaaattaaa

SEQ ID NO: 315 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgattctagcttatcttctagcctggtggttttcggtcaaggcacgaaagtggaaatcaaa

SEQ ID NO: 316 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgattctagctctggtccactggtggtgttcggtcaaggtaccaaggtggaaattaaa

SEQ ID NO: 317 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcgcggttggaagggtttagacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggatagcacgaccgacttaaactatgtgtttggtcaaggtacgaaagttgaaattaaa

SEQ ID NO: 318 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtacgcaataccgcgcctggtggtctgtgcgtggttacatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtctgtcttacacgagcacccataactgggttttcggtcagggtaccaaagtggagatcaaa

SEQ ID NO: 319 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtacgacgcgcttaggtgacaattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctctgggtgcccgctatgtgtttggtcaaggtacgaaagttgaaattaaa

SEQ ID NO: 320 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtacgacgcgcttaggtgacaattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagctctccagactatgtgtttggtcaaggtacgaaagttgaaattaaa

SEQ ID NO: 321 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttggggttaccgcggtgacatctatggctacttcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagcgcctacacgagcagcagcacggttttcggtcagggtaccaaagtggagatcaaa

SEQ ID NO: 322 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctgaccactttgtgtttggtcaaggtacgaaagttgaaattaaa

SEQ ID NO: 323 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtatgcagggctctcgttggccattagcctttggccagggtacgaaggttgaaatcaaa

SEQ ID NO: 324 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctacgttatatacctttggtcaaggtacgaaagttgaaattaaa

SEQ ID NO: 325 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaattctgccgacccgtataccttcggtcaaggtaccaaggtggaaattaaa

SEQ ID NO: 326 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctgggacagcaacacggttatgtttggccagggtacgaaggttgaaatcaaa

SEQ ID NO: 327 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacacggtgacgttgacacgatggccgtgccgttccacagctggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactcttctctgctgagctacgttttcggtcagggtaccaaagtggagatcaaa

SEQ ID NO: 328 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacactctccatctgagtcttggccactggatcactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcagctgggagagcaacgttaaccgtttttatgttttcggtcaaggcacgaaagtggaaatcaaa

SEQ ID NO: 329 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacacacgatctctgagcgcccatttaaaccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagggtaatacgccaggtcagacctttggtcaaggtacgaaagttgaaattaaa

SEQ ID NO: 330 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaatctggcgccgctacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacaggcctatagcttcccgccaacgttcggccagggcacgaaggttgagattaaa

SEQ ID NO: 331 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaattacgcgtttctcgcgactggtctaccaattaccaatggaatccatattttgatatctggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtagcagctatacgtcttcttctacctgggtttttggccagggtacgaaggtggagatcaaa

SEQ ID NO: 332 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaactacggtggttctttagacaattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtatgcaggccacctggccgccacagacgttcggtcagggcaccaaggttgagatcaaa

SEQ ID NO: 333 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaaactacggtggttctttagacaattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatatgataacccgccaccaacgtttggccagggtacgaaggttgaaatcaaa

SEQ ID NO: 334 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgccacgacgccttatgggccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtgcgtgggattctaatcacttacgcatttttggccaaggtacgaaggtggagattaaa

SEQ ID NO: 335 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgccacgacgccttatgggccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccaccatacacctttggccaaggtacgaaggtggagattaaa

SEQ ID NO: 336 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgccacgacgccttatgggccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctcttctcaccatgtgtttggtcaaggtacgaaagttgaaattaaa

SEQ ID NO: 337 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctggtaagtaccgccgcttcggcatttacccagattacatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagcaatattttaccaatcacgtttggtcagggcaccaaggttgagattaaa

SEQ ID NO: 338 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctggtaagtaccgccgcttcggcatttacccagattacatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagctatagccaaccaatcacgtttggtcagggcaccaaggttgagattaaa

SEQ ID NO: 339 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctaagacgtaccgcacgggtaccccgccagccccggccatggattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgttcttcttatattagctctggtacgtacgtgttcggccagggcacgaaggttgaaatcaaa

SEQ ID NO: 340 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctttatggggtggtttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacaataattctggcgttttcggtcagggcaccaaggttgagatcaaa

SEQ ID NO: 341 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctttatggggtggtttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagctctagcgccgttttcggccagggcacgaaggttgagattaaa

SEQ ID NO: 342 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctttatggggtggtttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagcacggtggttttcggtcagggcaccaaggttgagatcaaa

SEQ ID NO: 343 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctttatacggtggtatggactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaacctgggacagccgtttaaattctgccgtttttggccagggtacgaaggttgaaatcaaa

SEQ ID NO: 344 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatcttctttaatggttcgcggtgacatggtgccgcacttcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggcctgggactctagcagcattgttgttttcggtcagggtaccaaagtggagatcaaa

SEQ ID NO: 345 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagttatcccagagaaggttgccggcctggaccactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagttatgggatgacacgaacacccaggtgttattcggtcaaggcacgaaagtggaaatcaaa

SEQ ID NO: 346 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagttatcccagagaaggttgccggcctggactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttcttctgcgcatctggttttcggtcaaggcacgaaagtggaaatcaaa

SEQ ID NO: 347 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagtttctgccggtgttggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacacccaccgcggtgtggaagtgttcggtcaaggtaccaaggtggaaattaaa

SEQ ID NO: 348 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatactctgccccaggttacgccgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttcttctctgggcgtgttcggtcaaggtaccaaggtggaaattaaa

SEQ ID NO: 349 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccctgggttcttactggacgggtccatggaaggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagcacggaccaatgggtgtttggccaaggtacgaaggtggagattaaa

SEQ ID NO: 350 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaatcacaagccatacggtttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagctctccaaacgtggtgtttggtcaaggtacgaaagttgaaattaaa

SEQ ID NO: 351 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgtacgccgactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtacaatagctacagccaatactcttttggccagggtacgaaggttgaaatcaaa

SEQ ID NO: 352 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgtacgccgactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaagccaagatagctctggcgacttccgcgtgtttggccaaggtacgaaggtggagattaaa

SEQ ID NO: 353 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgtacgccgactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatgactacgtttttggccagggtacgaaggttgaaatcaaa

SEQ ID NO: 354 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgtacgccgactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatcacgttgtttttggccagggtacgaaggttgaaatcaaa

SEQ ID NO: 355 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccccgtacgccgactacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgctctagctacaccagctctagcacggttgtttttggccagggtacgaaggttgaaatcaaa

SEQ ID NO: 356 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtggtgttccacgcggttatgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctaccggcgtgttcggtcaaggtaccaaggtggaaattaaa

SEQ ID NO: 357 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtcgctctcgcggttggtacggctttgacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggccagcgactcttctagcgtggtgttcggtcaaggtaccaaggtggaaattaaa

SEQ ID NO: 358 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtgttggtgccacgccagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaagcgctgcaaaccccattaacgtttggccagggtacgaaggttgaaatcaaa

SEQ ID NO: 359 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtgttggtgccacgccagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaagcgcgtcaaagcccattaacgtttggccagggtacgaaggttgaaatcaaa

SEQ ID NO: 360 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccttaacgtggaactacccattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaaaatattacagcgccccacgcacctttggccaaggtacgaaggtggagattaaa

SEQ ID NO: 361 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcccaaggtgttttaacgcgcgaaagctactacggcggtatggattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaagaaaatagcccaccaatcacgtttggtcagggcaccaaggttgagattaaa

SEQ ID NO: 362 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcccgcgttggtgccacgccaacccatgccttcgatatctggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcgtgtttgggactctagcagcacctgggttttcggtcaaggcacgaaagtggaaatcaaa

SEQ ID NO: 363 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccacgcgctacttcgactggcaatatcgttacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttactctagcaccagcacgccatacgtttttggtcagggcaccaaggttgagattaaa

SEQ ID NO: 364 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccacgcgctacttcgactggcaatatcgttacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttacacgagcagcagctctgtttacgtttttggtcagggcaccaaggttgagattaaa

SEQ ID NO: 365 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccgcctacggtgacgttgtgcgtccagcctttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgacgttgccgtgaccgatggtcgctgggttttcggccaaggcaccaaagttgagatcaaa

SEQ ID NO: 366 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccgcctacggtgacgttgtgcgtccagcctttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcaatccggccgttgttttcggccaaggcaccaaagttgagatcaaa

SEQ ID NO: 367 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccgcctacggtgacgttgtgcgtccagcctttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctctgccgttggcggcagcgcccgctgggttttcggccaaggcaccaaagttgagatcaaa

SEQ ID NO: 368 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccttccgctacgacccacgtggcgagtacggcttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaaacgtggggcaatacccacttagttttcggccaaggcaccaaagttgagatcaaa

SEQ ID NO: 369 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgcccgctacgttccagacgatggctggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacgtacgtttttggccagggtacgaaggttgaaatcaaa

SEQ ID NO: 370 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgcccgctacgttccagacgatggctggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgggcgacagctctacggttctgtttggccaaggtacgaaggtggagattaaa

SEQ ID NO: 371 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcaccttagttgttttcggccaaggcaccaaagttgagatcaaa

SEQ ID NO: 372 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtgggacagctttggccaagttttcggtcagggtaccaaagtggagatcaaa

SEQ ID NO: 373 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtacgatgataatcgctctgccgttgtgttcggccagggcacgaaggttgaaatcaaa

SEQ ID NO: 374 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtgcctctggtgacttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagctgaacacctacccaccatggacctttggccaaggtacgaaggtggagattaaa

SEQ ID NO: 375 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtggtggtgactacggttttgatccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgatcgcttaccactgacctttggtcaaggtacgaaagttgaaattaaa

SEQ ID NO: 376 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtggtacggccgccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctccactggtggtgttcggtcaaggtaccaaggtggaaattaaa

SEQ ID NO: 377 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtggttaccgccgcacgaattattggttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcaacagccgcgactctgatagccatcaagccgttttcggccaaggcaccaaagttgagatcaaa

SEQ ID NO: 378 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtcgcgccccagcctctgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctgttgtgtttggccaaggtacgaaggtggagattaaa

SEQ ID NO: 379 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgatgtactattctagctatatggattactggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcagagctatgactcttctttaagcggtgatgtggtgttcggtcaaggcacgaaggtggagattaaa

SEQ ID NO: 380 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtataacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctccaccgccaacctttggccaaggtacgaaagttgagattaaa

SEQ ID NO: 381 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcgcggcgtgggacgactcttctctgtctggctatgtgttcggtcaaggcacgaaggtggagattaaa

SEQ ID NO: 382 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggccaaccgcttcccgttcacctttggccaaggtacgaaagttgagattaaa

SEQ ID NO: 383 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtctgacacgccaatgtatacgtttggccagggtacgaaggtggagatcaaa

SEQ ID NO: 384 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctccaccggcctatacctttggtcaaggtaccaaggttgaaatcaaa

SEQ ID NO: 385 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctccaccgccaacctttggccaaggtacgaaagttgagattaaa

SEQ ID NO: 386 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtactactcttacccgcaaacctttggccaaggtacgaaagttgagattaaa

SEQ ID NO: 387 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgactcttctctgtctggctggctgtttggtcaaggtaccaaggttgaaatcaaa

SEQ ID NO: 388 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagacctgggactctttcggtcaggtttttggccagggtacgaaggtggagatcaaa

SEQ ID NO: 389 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggactctaactctagcccacgtgtggtgttcggtcaaggcacgaaggtggagattaaa

SEQ ID NO: 390 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggactcttcttctgatttacagggcgtgttcggtcaaggcacgaaggtggagattaaa

SEQ ID NO: 391 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcagcagctacacgtcttctagcacgcgtggctttggtcaaggtaccaaggttgaaatcaaa

SEQ ID NO: 392 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacatcggttctggtgccttcgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaccaatcacctttggccaaggtacgaaggtggagattaaa

SEQ ID NO: 393 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaaggaggcctaccgctctagcaattcttactggtatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtggtacgtgggatagcagctctggtgccggtgtgttcggccagggcacgaaggttgaaatcaaa

SEQ ID NO: 394 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaagggtgccgacacgccatttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtctgcagtaccatgccttcgccagctttggccaaggtacgaaggtggagattaaa

SEQ ID NO: 395 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaagggtggtatggttccattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatgacagcgttccattaacctttggccaaggtacgaaggtggagattaaa

SEQ ID NO: 396 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaagggtggtatgtacggtttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatgacagcttaccattaacctttggccaaggtacgaaggtggagattaaa

SEQ ID NO: 397 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaagtctggttaccgctctggccatatcggtatttacggcggcctgggtatggacgtttggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccaggtttgggactcttctagcttctgggtgtttggccaaggtacgaaagttgagattaaa

SEQ ID NO: 398 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttattcgcctaccgccacgtgggctacggttgcttcgattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtggtacgtgggatagccgtttattatctggtggcatgttcggccagggcacgaaggttgaaatcaaa

SEQ ID NO: 399 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaggtaactaccgctctaaacaggtttactttaacgcgtttgatatctggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggcgtgggattctcgctctgccaatgttgcgtttggccaaggtacgaaagttgagattaaa

SEQ ID NO: 400 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggtgcctggggtccaggcggcttcgacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactacaccccgctgacgttcggtcaaggcacgaaagtggaaatcaaa

SEQ ID NO: 401 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggtatcgccgttgcggcgaactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgatatctctttaagcgcgctggttttcggtcaaggcacgaaagtggaaatcaaa

SEQ ID NO: 402 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctctttattacgcgcgtcttgggtgtttggccaaggtacgaaagttgagattaaa

SEQ ID NO: 403 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctctacgacggccggcgtttttggccagggtacgaaggtggagatcaaa

SEQ ID NO: 404 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaacgggttaccgctctcgtagctaccaatgggatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtatgcaagccctgaccccgacgatctctttcggccaaggcaccaaagttgagatcaaa

SEQ ID NO: 405 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaacgggttaccgctctcgtagctaccaatgggatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctctttatctgcctatgtttttggccagggtacgaaggtggagatcaaa

SEQ ID NO: 406 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaacgggttaccgctctcgtagctaccaatgggatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctctttatctggttatgtttttggccagggtacgaaggtggagatcaaa

SEQ ID NO: 407 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaacggtgccggtgccttcggcgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagctgaacagcaacccaccatggacctttggccaaggtacgaaggtggagattaaa

SEQ ID NO: 408 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaacttaggttaccgcggtacccattctggttatgccatggatagctggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagcacgtctgttgtttttggtcagggcaccaaggttgagattaaa

SEQ ID NO: 409 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaaccaatacggtgccgacgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagacctacaccttaccaatcacctttggccaaggtacgaaggtggagattaaa

SEQ ID NO: 410 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccagccttatactctggtatggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcgagacctggggccgcgatacgcgcgtttttggccagggtacgaaggttgaaatcaaa

SEQ ID NO: 411 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccagactcttaccgctctagcggcacgtactatttcgatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatatgatagcccaccatggacgttcggccaaggcaccaaagttgagatcaaa

SEQ ID NO: 412 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccacacggtgttatggactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaacctggggtaccggcgaggtggttttcggtcagggcaccaaggttgagatcaaa

SEQ ID NO: 413 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccattaggttacttagacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagacgtggggcaccggtattcacggtgtttttggccagggtacgaaggttgaaatcaaa

SEQ ID NO: 414 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaatggccacgcgctactactattatggtatggacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctggcctgggcgttttcggtcaaggcacgaaagtggaaatcaaa

SEQ ID NO: 415 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggttctttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagacgtggggcaccggtaccgttgttttcggccagggcacgaaggttgagattaaa

SEQ ID NO: 416 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggttctttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggattattctagcgacttacacgtggtgtttggtcaaggtacgaaagttgaaattaaa

SEQ ID NO: 417 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggttcttctggtctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctgcccacgtggtgtttggtcaaggtacgaaagttgaaattaaa

SEQ ID NO: 418 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggttcttctggtctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctttaagcggcccgaactgggttttcggtcagggtaccaaagtggagatcaaa

SEQ ID NO: 419 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaacgggttaccgcttaagcagcttatactattacgcgggctttgcctacggtatggatctgtggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtcaagcctgggacagctctacctatgtgttcggtcaaggcacgaaggtggagattaaa

SEQ ID NO: 420 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaacgggttaccgcttaagcagcttatactattacgcgggctttgcctacggtatggatgtgtggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtatgcaagagacgcattggccacatacctttggtcaaggtaccaaggttgaaatcaaa

SEQ ID NO: 421 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaacgcgccgcttcgacctgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagcacgccgggtgttgtttttggccagggtacgaaggttgaaatcaaa

SEQ ID NO: 422 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccaacgcggttacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagctctccgtctgttgtttttggccagggtacgaaggttgaaatcaaa

SEQ ID NO: 423 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccaaacgtactacgactctagcctgtcttacggctacgcgtttgatatctggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtgaaacctggggctctaacacgcgcgtgttcggccagggcacgaaggttgaaatcaaa

SEQ ID NO: 424 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtttagttttcgatctgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcaaggcgtgggattctagcacgtctgttgtgtttggccaaggtacgaaggtggagattaaa

SEQ ID NO: 425 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtcgcgacggttatggcatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagcgactctccaccgctgaccttcggtcaaggtaccaaggtggaaattaaa

SEQ ID NO: 426 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctggccgcccgctgggtttttggtcagggcaccaaggttgagattaaa

SEQ ID NO: 427 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcaattctgcctgggttttcggccaaggcaccaaagttgagatcaaa

SEQ ID NO: 428 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaccaacgttcggccaaggcaccaaagttgagatcaaa

SEQ ID NO: 429 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgttcgatcgtagcttatctggtgccgtgttcggccagggcacgaaggttgaaatcaaa

SEQ ID NO: 430 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtgggacagctttggccaagttttcggtcagggtaccaaagtggagatcaaa

SEQ ID NO: 431 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgctctcgcgaactgttctggcaatttgacttttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagccgtacctctgccgttttcggccaaggcaccaaagttgagatcaaa

SEQ ID NO: 432 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgaaacctgggacagctacacgcacacctttggccaaggtacgaaggtggagattaaa

SEQ ID NO: 433 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcgcgtgggacagctctttattaagcgcggcgggtgttttcggtcagggtaccaaagtggagatcaaa

SEQ ID NO: 434 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagccgcttattaagcggcggcatgttcggtcaaggtaccaaggtggaaattaaa

SEQ ID NO: 435 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagccgcacgggtgtgtttggccaaggtacgaaggtggagattaaa

SEQ ID NO: 436 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctcttctacggatgtggtgttcggtcaaggtaccaaggtggaaattaaa

SEQ ID NO: 437 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactattcttctccatatacctttggtcaaggtacgaaagttgaaattaaa

SEQ ID NO: 438 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgtgattctttcggtcaggtgtttggtcaaggtacgaaagttgaaattaaa

SEQ ID NO: 439 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtcaagtgtttggccaaggtacgaaggtggagattaaa

SEQ ID NO: 440 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctgaccattgggtgtttggtcaaggtacgaaagttgaaattaaa

SEQ ID NO: 441 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcaaggacttccgcatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtgcggagtgggcggattctctgtctggtggtgtgtttggccaaggtacgaaggtggagattaaa

SEQ ID NO: 442 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctcgtacggttatctttggccagggtacgaaggttgaaatcaaa

SEQ ID NO: 443 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagctctacggttgtgtttggccaaggtacgaaggtggagattaaa

SEQ ID NO: 444 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacgggtgttgtgtttggccaaggtacgaaggtggagattaaa

SEQ ID NO: 445 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacgccagacgtggtgtttggtcaaggtacgaaagttgaaattaaa

SEQ ID NO: 446 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacggttatctttggccagggtacgaaggttgaaatcaaa

SEQ ID NO: 447 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacggttgtttttggccagggtacgaaggttgaaatcaaa

SEQ ID NO: 448 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctaccgccggtacggtgtttggccaaggtacgaaggtggagattaaa

SEQ ID NO: 449 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctaccacggccgttgtgtttggccaaggtacgaaggtggagattaaa

SEQ ID NO: 450 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagcggtgaccaagcggtgtttggtcaaggtacgaaagttgaaattaaa

SEQ ID NO: 451 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccaaggcgtgtttggtcaaggtacgaaagttgaaattaaa

SEQ ID NO: 452 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcgaaacctgggactctttcaaccatttagtgtttggccaaggtacgaaagttgagattaaa

SEQ ID NO: 453 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcatgcaggcgacgcaattcccacgtacgtttggccagggtacgaaggtggagatcaaa

SEQ ID NO: 454 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcattacgactctacgccgatcacctttggccaaggtacgaaagttgagattaaa

SEQ ID NO: 455 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacggttcttctagcccagattataccttcggtcaaggcacgaaggtggagattaaa

SEQ ID NO: 456 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgactcttctaatcacgtggtgtttggtcaaggtaccaaggttgaaatcaaa

SEQ ID NO: 457 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagacctgggactctttcggtcaggtttttggccagggtacgaaggtggagatcaaa

SEQ ID NO: 458 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcagcgcgtgggactcttctcgcagcgccggcgtgtttggtcaaggtaccaaggttgaaatcaaa

SEQ ID NO: 459 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtacgttctctacggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctacgctggtggtgttcggtcaaggtaccaaggtggaaattaaa

SEQ ID NO: 460 - DNA, 783 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctttataccgcggtggtggctatttatactatgccagctggtggatggatctgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggataattctttatctgacggccactatgtgtttggtcaaggtaccaaggttgaaatcaaa

SEQ ID NO: 461 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactcttctaactggttcggtatcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagcgcggacagctctggtgccatttttggccaaggtacgaaggtggagattaaa

SEQ ID NO: 462 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacacgggttaccgcggtacgagcatgctgatcgaccattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcatgcaaggcttacaaggtccgacctttggtcaaggtacgaaagttgaaattaaa

SEQ ID NO: 463 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacacgggttaccgcggtacgagcatgctgatcgaccattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcatgcaaggcacgcacggtcgtccgagcacgttcggtcaaggcacgaaagtggaaatcaaa

SEQ ID NO: 464 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttttcccatactggttcgacagctggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgcgggtcgtcacgttgtttttggccagggtacgaaggttgaaatcaaa

SEQ ID NO: 465 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttggtcgcggtcgcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctccgccaatcacgtttggccagggtacgaaggttgaaatcaaa

SEQ ID NO: 466 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttatcgttgttggttcttggacctatgccttcggctactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcacgtgggactctagcctgaccggtttatctggtgtgttcggccagggcacgaaggttgaaatcaaa

SEQ ID NO: 467 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttaagaactaccgcgcctatgaattacacagcttaaattttatggatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggtgtgggattcttcttcttctgatcgcgtggtgtttggtcaaggtaccaaggttgaaatcaaa

SEQ ID NO: 468 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgtttctggtgacggtttcgatttttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagctatgacagctctttattaggcccgtatgttgttttcggtcagggtaccaaagtggagatcaaa

SEQ ID NO: 469 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaggccgtttctccatactctaatagcccacgcgcggactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcaccccgggtgttgttttcggccaaggcaccaaagttgagatcaaa

SEQ ID NO: 470 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggtggtttcggtgcctctgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcccaccaatcacctttggccaaggtacgaaggtggagattaaa

SEQ ID NO: 471 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggtggtcgcttaggtttcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcgccccagccgtggtgtttggtcaaggtacgaaagttgaaattaaa

SEQ ID NO: 472 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggtcgccgcggtatggacgtttggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacaggaggatagcccaccgatcacgttcggccagggcacgaaggttgagattaaa

SEQ ID NO: 473 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggttctggttacgagtctgatagctcttctcgtgttgattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaagcgtatagcccaccagttacgtttggtcagggcaccaaggttgagattaaa

SEQ ID NO: 474 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggttaccgctgtgcctcttgcggcgccttcgatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcacgtgggactctagcctgagcggtgttttcggtcagggtaccaaagtggagatcaaa

SEQ ID NO: 475 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagaacttatggtctgcctctggtggcgcgccatctatggatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtacccaatctttacagccgccgatcgttttcggtcagggtaccaaagtggagatcaaa

SEQ ID NO: 476 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagccataccgcgttcgcttatttcgttacatggactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaagctacgactctcgtctgagcggtttctacgtttttggtcagggcaccaaggttgagattaaa

SEQ ID NO: 477 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcgccggttacggtgtttggagcgcgacgcgcatggattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaagcctacagcccgccggttacgttcggtcagggtaccaaagtggagatcaaa

SEQ ID NO: 478 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgcctcttgggacgatagcctgaacggtcgcgtttttggtcagggcaccaaggttgagattaaa

SEQ ID NO: 479 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgtctgccggtggtgtgttcggccagggcacgaaggttgaaatcaaa

SEQ ID NO: 480 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagcctatagcccgccagttacgttcggccaaggcaccaaagttgagatcaaa

SEQ ID NO: 481 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagaggatagcccgccaatcacgttcggccaaggcaccaaagttgagatcaaa

SEQ ID NO: 482 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgatagcccgccaatcacgttcggccaaggcaccaaagttgagatcaaa

SEQ ID NO: 483 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctaatagcccgccaatcacgttcggccaaggcaccaaagttgagatcaaa

SEQ ID NO: 484 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaatcacgttcggccaaggcaccaaagttgagatcaaa

SEQ ID NO: 485 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaccaacgttcggccaaggcaccaaagttgagatcaaa

SEQ ID NO: 486 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaatcttacgatgataccggtccattattcggccaaggcaccaaagttgagatcaaa

SEQ ID NO: 487 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggttctggtgagtacgcggtggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagcgactctccaccgattaccttcggtcaaggtaccaaggtggaaattaaa

SEQ ID NO: 488 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaggttggtcgcgcctctcgccattatttcatctatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatattatagcccaccaatcacgtttggtcagggcaccaaggttgagattaaa

SEQ ID NO: 489 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggcgcggtttcccatactactattatgcctcttggatggatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggcctgggactctagcacctatgttttcggtcaaggcacgaaagtggaaatcaaa

SEQ ID NO: 490 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttcggtcaagacacgttacgctatgcgtacggtatggatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatacgacaatctgccgatcacgttcggtcagggtaccaaagtggagatcaaa

SEQ ID NO: 491 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttcggtcaagacacgttacgctatgcgtacggtatggatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatacgacagcctgccgatcacgttcggtcagggtaccaaagtggagatcaaa

SEQ ID NO: 492 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttctctggtcgctacaacggtgattttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggtttgggattctggttctctgcatccggttttcggtcaaggcacgaaagtggaaatcaaa

SEQ ID NO: 493 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttctacggtcgcgttggttactattatggtatggacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacgacttaccgccgatttctttcggtcaaggcacgaaagtggaaatcaaa

SEQ ID NO: 494 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgccgacttaacgtactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatatggtagcagctctccgggttactcttttggccagggtacgaaggttgaaatcaaa

SEQ ID NO: 495 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgcctcttcttcttactgggagccggataactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcctgggattcttctttaaatctgctgtacgttttcggtcagggtaccaaagtggagatcaaa

SEQ ID NO: 496 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgcctaccgccgcgttccaaaaatgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatattactctgccccgtataccttcggtcaaggtaccaaggtggaaattaaa

SEQ ID NO: 497 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgcctaccgccgcgttccaaaaatgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatattactctccaccgcataccttcggtcaaggtaccaaggtggaaattaaa

SEQ ID NO: 498 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgactacaacgccttcgaccgttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtgaaacgtgggatagcttcaatcacttagtttttggccagggtacgaaggttgaaatcaaa

SEQ ID NO: 499 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgactaccgcgttacgggtagcaccacgtactttgaccattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaatcttacgatagcagcttatctggtggtggcgtttttggccagggtacgaaggtggagatcaaa

SEQ ID NO: 500 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggttctccatctgaccactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtactatgatggtcgtcgcacgttcggccagggcacgaaggttgagattaaa

SEQ ID NO: 501 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggttactcttcttcttactattggtatggtatggacctgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccttacaagcgccgattacgttcggtcaaggcacgaaagtggaaatcaaa

SEQ ID NO: 502 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaaggcctggggttggttcgacccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagttcgatagcatcccgtggacgttcggtcagggcaccaaggttgagatcaaa

SEQ ID NO: 503 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaaggcctggggttggttcgacccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtactatagcttcccgtggacgttcggtcagggcaccaaggttgagatcaaa

SEQ ID NO: 504 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaagcgcgcctctggtgacgcgtttggtccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctttaagcggcctgtcttacgttttcggccaaggcaccaaagttgagatcaaa

SEQ ID NO: 505 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctctttatctgaccagggttgggtgtttggccaaggtacgaaagttgagattaaa

SEQ ID NO: 506 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctcttcttctccacgttgggtttttggccagggtacgaaggtggagatcaaa

SEQ ID NO: 507 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagaccagcgacttcccatacaccttcggccagggcacgaaggttgaaatcaaa

SEQ ID NO: 508 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagtataattcttactcttggacgtttggtcagggcaccaaggttgagattaaa

SEQ ID NO: 509 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttataccgcggtttcggtgtgggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacaactcttatagcccggttacgttcggtcagggtaccaaagtggagatcaaa

SEQ ID NO: 510 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccaggtggtatgtctggttggatcggctattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttatcttctctggattatgttttcggtcaaggcacgaaagtggaaatcaaa

SEQ ID NO: 511 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccataccgccgctcttactttagctacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcacgtggggttctaccggcattgttttcggtcaaggcacgaaagtggaaatcaaa

SEQ ID NO: 512 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccataccgccgctcttactttagctacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaagaggacaatctgccgccaacgttcggtcagggtaccaaagtggagatcaaa

SEQ ID NO: 513 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcaaggtccatacttaccatattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagcacgccgaaggttgtttttggccagggtacgaaggttgaaatcaaa

SEQ ID NO: 514 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcgcctaccgctctgccccggcggcctactggatggatatctggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcacgtgggactctagcctgaatgttgttgttttcggccaaggcaccaaagttgagatcaaa

SEQ ID NO: 515 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcggtatctactactctggcggctctcgcagcttatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcacgtgggactctagcctgggcgccgcctggatcttcggccaaggcaccaaagttgagatcaaa

SEQ ID NO: 516 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcggtgttatcgttgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtaattcttgggatagccgcggcggtcacttagtggtgtttggtcaaggtacgaaagttgaaattaaa

SEQ ID NO: 517 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcggtgttatcgttgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagctctccgtctgttgtttttggccagggtacgaaggttgaaatcaaa

SEQ ID NO: 518 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcggtgtttcttactacggcctggacatgtggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttatctagcctggattacgttttcggtcagggtaccaaagtggagatcaaa

SEQ ID NO: 519 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctctcgcatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagtctagcgacaatgcgacggatatcacgcaaccggtgtttggtcaaggtacgaaagttgaaattaaa

SEQ ID NO: 520 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctacgacatcttaacgcgttatggttactatttcgattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatattatagcccaatcttcatgttcggccaaggcaccaaagttgagatcaaa

SEQ ID NO: 521 - DNA, 768 bp, Artificial Sequence; identical to SEQ ID NO: 50
  Description of Artificial Sequence: Synthetic polynucleotide

SEQ ID NO: 522 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctactctggtcgcacgggctattcttactggctgcactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgccgcctgggacgatagcctgaacggtccagttgtgttcggccagggcacgaaggttgaaatcaaa

SEQ ID NO: 523 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctactacgactcttctccgccgtacggttatgcctttgatatttggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagagctattctccaccaatcaccttcggccagggcacgaaggttgaaatcaaa

SEQ ID NO: 524 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttctgccgcccacggttaccattttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttcttctagcctggcggttgttttcggtcagggtaccaaagtggagatcaaa

SEQ ID NO: 525 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttctggtaagcgcggttctggcgtggaccactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctttaagcggcctgtcttacgttttcggccaaggcaccaaagttgagatcaaa

SEQ ID NO: 526 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttacgcctctatcttagatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccatctccaggctttaccttcggtcaaggtaccaaggtggaaattaaa

SEQ ID NO: 527 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttaccgcacgtcttctagcaaacaatacctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgccgcctgggacgatcgtctgaacggttacgtttttggtcagggcaccaaggttgagattaaa

SEQ ID NO: 528 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttaccgcacgtcttctagcaaacaatacctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacgatagcagctctggttctttagtgttcggccagggcacgaaggttgaaatcaaa

SEQ ID NO: 529 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttaccgcacgtcttctagcaaacaatacctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcagctctccagttttcggccaaggcaccaaagttgagatcaaa

SEQ ID NO: 530 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagcgacgccgttttcggccaaggcaccaaagttgagatcaaa

SEQ ID NO: 531 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagctctacgtacgttgtgttcggccagggcacgaaggttgaaatcaaa

SEQ ID NO: 532 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcaccccacgcgccgtttttggtcagggcaccaaggttgagattaaa

SEQ ID NO: 533 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaacgtagcaattggccattaacgttcggccaaggcaccaaagttgagatcaaa

SEQ ID NO: 534 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaacgtagcaattggtggccaccattcacgtttggtcagggcaccaaggttgagattaaa

SEQ ID NO: 535 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagctatagcccaccaccaacgtttggtcagggcaccaaggttgagattaaa

SEQ ID NO: 536 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatataataattggccaacgttcggtcagggtaccaaagtggagatcaaa

SEQ ID NO: 537 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctctttatctggtagcgtttttggccagggtacgaaggtggagatcaaa

SEQ ID NO: 538 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctcttctttaggtgcggttgtgtttggccaaggtacgaaagttgagattaaa

SEQ ID NO: 539 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaaacgtgggatagctttggtcaagttttcggccaaggcaccaaagttgagatcaaa

SEQ ID NO: 540 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagctctgcccacgttgtgttcggccagggcacgaaggttgaaatcaaa

SEQ ID NO: 541 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagctctgaccactctgtggtttttggccagggtacgaaggtggagatcaaa

SEQ ID NO: 542 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttactcttaccgctctatgtaccgtgattacttcgatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatactacagcaataccccatacacgttcggccaaggcaccaaagttgagatcaaa

SEQ ID NO: 543 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttactaccgcacggccaactatctgtacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttacacgagcagcagccacttagccttcggccaaggcaccaaagttgagatcaaa

SEQ ID NO: 544 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgccgacttcgagcaacaactggcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcatgcaaagccgccaattaccgctgaccttcggtcaaggtaccaaggtggaaattaaa

SEQ ID NO: 545 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgccggtttaatctctatcgcggcgttagacgaatggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaagctggttcccacacgtggtgtttggtcaaggtacgaaagttgaaattaaa

SEQ ID NO: 546 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgccggtttaatctctatcgcggcgttagacgaatggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaacctgggactctggtagcgtggtgttcggtcaaggtaccaaggtggaaattaaa

SEQ ID NO: 547 - DNA, 783 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgccggtttacgcggttacagctatggttacaattctaccccgccgcgcccaaactggtttgatccgtggggccaatggggtcaaggtacgctggttacggtgagcagcggtggcagctctcgtagcagctctagcggcggtggcggcagcggcggcggcggcgaaatcgttctgacgcaaagcccggcgacgctgtctttatctccgggtgagcgcgcgacgctgtcttgccgcgcgagccaatctgtgtctagctcttacctggcgtggtatcaacagaagccaggtcaggccccacgcttactgatttatggtgcgagcagccgcgcgaccggcatcccagcgcgtttttctggtagcggctctggtacggatttcacgctgacgatttctcgtctggagccggaggacttcgcggtgtattactgtcaaacgtggggcacgggcgaagtggttttcggtcagggtacgaaagttgaaattaaa

SEQ ID NO: 548 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtgcccgccgccacttactggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtcaagtgtttggccaaggtacgaaggtggagattaaa

SEQ ID NO: 549 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtggtggtacgtcttctggcccggacggttatgactatgcgatggatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcagcagcataactcttacccactgacgtttggccagggtacgaaggtggagatcaaa

SEQ ID NO: 550 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtggtttattagacgcctttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgattacttagttagctttggccaaggtacgaaggtggagattaaa

SEQ ID NO: 551 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtaagatcggtccaaacgcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatgactcttacccgccgaccttcggtcaaggtaccaaggtggaaattaaa

SEQ ID NO: 552 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtttaaactggaacgttatggactttgcgttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacgactctccgccggtgacgttcggtcaaggcacgaaagtggaaatcaaa

SEQ ID NO: 553 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtcgcgagttaatcccacagtttgaccactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcctgggatgactctttaaatattggctgggttttcggtcaaggcacgaaagtggaaatcaaa

SEQ ID NO: 554 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtcgcgagttaatcccacagtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcctgggatgacggtcgcagcggcccgaactgggttttcggtcagggtaccaaagtggagatcaaa

SEQ ID NO: 555 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggttctttagccggtcgcgcgtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatgacaacccaccggtgaccttcggtcaaggtaccaaggtggaaattaaa

SEQ ID NO: 556 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtgttttagacttcgccatggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcattctagcccaccaatcacctttggccaaggtacgaaggtggagattaaa

SEQ ID NO: 557 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccacccatctgccgccggtgcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctacgccgccgtggaccttcggtcaaggtaccaaggtggaaattaaa

SEQ ID NO: 558 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacatccgcggtggtatgaacgtttggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtactatagcccaccgatcacgttcggccagggcacgaaggttgagattaaa

SEQ ID NO: 559 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacccacgccacatcacggccagcaaaccatacaccggtggcggcagccaatactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggactcttctacgaatcactgggtgtttggccaaggtacgaaagttgagattaaa

SEQ ID NO: 560 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcgccggttaccacatcgatggctggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcccattagttgtgtttggccaaggtacgaaggtggagattaaa

SEQ ID NO: 561 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcttctctggttctcaatatgcgttcttcgatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttacacgagcagcagcacgttagttgtttttggtcagggcaccaaggttgagattaaa

SEQ ID NO: 562 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggttctacgttatacgaaaattacatggacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagcacgagtactggccgctgaccttcggtcaaggtaccaaggtggaaattaaa

SEQ ID NO: 563 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggtgttgccggttactatgcgtacttcgatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttacacgagcagcagcacgttagttgtttttggtcagggcaccaaggttgagattaaa

SEQ ID NO: 564 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgccgcttccgcggttctgattattactcttataactatccgatggatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggtgtgggattcttctgccttagtggtttttggccagggtacgaaggtggagatcaaa

SEQ ID NO: 565 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgctctcaaggttacttcgatctgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttacgctctctggtggtgttcggtcaaggtaccaaggtggaaattaaa

SEQ ID NO: 566 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgctctcaaggttacttcgatctgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcacgttcgttgtgtttggccaaggtacgaaggtggagattaaa

SEQ ID NO: 567 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctgccccagcggtggtgttcggtcaaggtaccaaggtggaaattaaa

SEQ ID NO: 568 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttattaccgggctatgttttcggtcaaggcacgaaagtggaaatcaaa

SEQ ID NO: 569 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttacgcgtgagctatgttttcggtcaaggcacgaaagtggaaatcaaa

SEQ ID NO: 570 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacgttcgtggtgtttggtcaaggtacgaaagttgaaattaaa

SEQ ID NO: 571 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacgtacgtggtgtttggtcaaggtacgaaagttgaaattaaa

SEQ ID NO: 572 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagcacgtctttagtggtgtttggtcaaggtacgaaagttgaaattaaa

SEQ ID NO: 573 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcacgtctgccggtaagattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagcacgacgttagtggtgtttggtcaaggtacgaaagttgaaattaaa

SEQ ID NO: 574 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactctggtggttctttacgcggcatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacattggtacgtacgtggtgtttggtcaaggtacgaaagttgaaattaaa

SEQ ID NO: 575 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactcttcttactacggtaactttgatccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcggcgtgggacgattctttaaacggctatgtgttcggtcaaggtaccaaggtggaaattaaa

SEQ ID NO: 576 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacacgggtgccatctacttcgcggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaataactggccaccatggacctttggccaaggtacgaaggtggagattaaa

SEQ ID NO: 577 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacacgggtgactctcgcgttggcgtgatcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctacctatgtggttttcggtcaaggcacgaaagtggaaatcaaa

SEQ ID NO: 578 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgttatcacgggttcttacggccagggtccatttgacgattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcagcacgcacgttgtttttggtcagggcaccaaggttgagattaaa

SEQ ID NO: 579 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactggggtttccgctacttcgacttttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcgcctatacccgcgcgaacccacaaaccctgtatgttttcggtcaaggcacgaaagtggaaatcaaa

SEQ ID NO: 580 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactactctcgcacgtctgccccgtattacaacgcggttgatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagctatagcccaccattaacgtttggtcagggcaccaaggttgagattaaa

SEQ ID NO: 581 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatcaaccgcgttcgcacgttcgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccaccaacctttggccaaggtacgaaggtggagattaaa

SEQ ID NO: 582 - DNA, 771 bp, Artificial Sequence; identical to SEQ ID NO: 55
  Description of Artificial Sequence: Synthetic polynucleotide

SEQ ID NO: 583 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaaaccgcttattcgccttagatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaacctgggattctagcggtgttgtttttggccagggtacgaaggttgaaatcaaa

SEQ ID NO: 584 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaccagccggtatcgacgccggctttgacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgaatcttgggatgacaaggcctattgggtgtttggtcaaggtacgaaagttgaaattaaa

SEQ ID NO: 585 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaccaggtgccacgtctaagagctggtattacacgcgtggttttgattattggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaaacctggggcaccggttctttagtttttggtcagggcaccaaggttgagattaaa

SEQ ID NO: 586 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttacgcggttcttacgactacgaagcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacaacaactggccgcgttatacgttcggtcaaggcacgaaagtggaaatcaaa

SEQ ID NO: 587 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttacgcggttcttactaccgcaattggtttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcgtcttttgacttagacgcgctgtgggtgttcggtcaaggtaccaaggtggaaattaaa

SEQ ID NO: 588 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaacgccaggtttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagccgtgccgatcactgggttttcggccagggcacgaaggttgagattaaa

SEQ ID NO: 589 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgggtacgatcccacgccaccactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgataacccaccagtgagctttggtcaaggtacgaaagttgaaattaaa

SEQ ID NO: 590 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtggcacgtgggattctagcctgaacccggttgttttcggccagggcacgaaggttgagattaaa

SEQ ID NO: 591 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtggcacgtgggattctagcctgtctgcggttgccgtttttggccagggtacgaaggttgaaatcaaa

SEQ ID NO: 592 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtggcacgtgggattctagcagctctcatttaaaggtttttggccagggtacgaaggttgaaatcaaa

SEQ ID NO: 593 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagacgtggggcacggtggtgttcggccaaggtacgaaagtggaaatcaaa

SEQ ID NO: 594 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcgcccagagttagactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagacgtgggattctagcaccgttgtgttcggtcaaggcaccaaagttgagatcaaa

SEQ ID NO: 595 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcgccgctcttcttacttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtagctcttatacctctagctcttctttatgggtgtttggccaaggtacgaaggtggagattaaa

SEQ ID NO: 596 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcgctctggtggttggttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagcccaagcgttgttttcggccagggcacgaaggttgagattaaa

SEQ ID NO: 597 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcgctctggtggttggttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaacctgggccagcagcggttgggtgttcggtcaaggcaccaaagttgagatcaaa

SEQ ID NO: 598 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgtctgccggtggtaagttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtctgtggattctagcggtacgtgggtttttggccagggtacgaaggttgaaatcaaa

SEQ ID NO: 599 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaacggtcgcacggttacgaagggcatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggttaattctttcccaccgacctttggtcaaggtacgaaagttgaaattaaa

SEQ ID NO: 600 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaacggtcgcacggttacgaagggcatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgattcttctccaccgattaccttcggtcaaggtaccaaggtggaaattaaa

SEQ ID NO: 601 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcggttggacgggttctttcgatctgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagcaacagcccaccaatcacctttggccaaggtacgaaggtggagattaaa

SEQ ID NO: 602 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgccgcttatctccaggtggcggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtctgactctccgccgattacgttcggtcaaggcacgaaagtggaaatcaaa

SEQ ID NO: 603 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgccgcttatctccaggtggcggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtcttactctccgccgccgacgttcggtcaaggcacgaaagtggaaatcaaa

SEQ ID NO: 604 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggtcaaggtgacttaaatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggatgttagctctgacccagcgtgggtgtttggtcaaggtacgaaagttgaaattaaa

SEQ ID NO: 605 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactctggttggtacggtgtttcttggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatcaatgggttttcggccagggcacgaaggttgagattaaa

SEQ ID NO: 606 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaactcttctggttactactcttattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagacgtggggcaccggtattcgcatcttcggccagggcacgaaggttgagattaaa

SEQ ID NO: 607 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtccaaagcgcacggttttaggtagcacccgcttcgatatctggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtggcgcctgggactctagcgataatgcccgcgttttcggccaaggcaccaaagttgagatcaaa

SEQ ID NO: 608 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgccccaggttactcttctggcattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtggggcacgggtatccgtgtgtttggtcaaggtacgaaagttgaaattaaa

SEQ ID NO: 609 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgccgttggtttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccaccaggtgtttggtcaaggtacgaaagttgaaattaaa

SEQ ID NO: 610 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgacccaggtacgtggcaattcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgtcttatacccacgcgaacacggttgtggcgtttggtcaaggtacgaaagttgaaattaaa

SEQ ID NO: 611 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgactactctaactcttactattattactacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcaatgccatgcgcatcttcggccaaggcaccaaagttgagatcaaa

SEQ ID NO: 612 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcggtggtggtcacgacggttttgatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacacctctatcccacatgtggtgttcggtcaaggtaccaaggtggaaattaaa

SEQ ID NO: 613 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcttagtttcttctgactctccgtatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgagaattgggactctaacacccgtgtgttcggtcaaggtaccaaggtggaaattaaa

SEQ ID NO: 614 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatgtctggtatcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtaaacaatataacaatctgccaattacgttcggtcagggcaccaaggttgagatcaaa

SEQ ID NO: 615 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatgtctggtatcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatatgacaatctgccactgacgttcggtcagggcaccaaggttgagatcaaa

SEQ ID NO: 616 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatgtctggtatcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatataacaattggccgttaaccttcggtcaaggcaccaaagttgagatcaaa

SEQ ID NO: 617 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatgtctggtatcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatataaccgttttccactgatcttcggtcagggcaccaaggttgagatcaaa

SEQ ID NO: 618 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatgtctggtatcgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatataacagctttccactgacgttcggtcagggcaccaaggttgagatcaaa

SEQ ID NO: 619 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcaacatgttacgcttaggtcgcgcgtttgactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtggggcacgggtatccgtgtgtttggtcaaggtacgaaagttgaaattaaa

SEQ ID NO: 620 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcccaacgtacggtgttccaatggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttatctgccgtggtgtttggtcaaggtacgaaagttgaaattaaa

SEQ ID NO: 621 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgccgcatcggttctttctctctgggcccattcgatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtagctcttacggtggctataataactacgttttcggccaaggcaccaaagttgagatcaaa

SEQ ID NO: 622 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctggtgttcactaccgcgccgtgggcggttctgcgcgcctgaccgattacatggacgtttggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagcactacgacaactggccgccaacctttggccaaggtacgaaagttgagattaaa

SEQ ID NO: 623 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctcacggtcacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtacaataatttcccgttaacgttcggccagggcacgaaggttgagattaaa

SEQ ID NO: 624 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctatcgccgccgcctacgcctttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagaactattctacgccaccgtggacctttggtcaaggtacgaaagttgaaattaaa

SEQ ID NO: 625 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctaagtaccactactacggtctgagcaacgttacctacggcgcgggcttcgactactggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagcaatacaacccaccgccagtgacctttggtcaaggtaccaaggttgaaatcaaa

SEQ ID NO: 626 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctccaggtttacgcggtaacgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtagctatggtgcggttggtgtttttggccagggtacgaaggttgaaatcaaa

SEQ ID NO: 627 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctcaaccacgcccacgctacaattatggtaagtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcacccgcgttttcggtcagggtaccaaagtggagatcaaa

SEQ ID NO: 628 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctcgcttaggtgacgccttcgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatgacaatttaccattaacctttggccaaggtacgaaggtggagattaaa

SEQ ID NO: 629 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctacgttctactacggttctggccgtccatacagcgcctggtttgatccgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaaacctgggatagccgcaagacggttgtgttcggccagggcacgaaggttgaaatcaaa

SEQ ID NO: 630 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgggtggttcttctggtggttttgcgttatacggcttcggcatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagctctgacttaccagtggtttttggccagggtacgaaggtggagatcaaa

SEQ ID NO: 631 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgttaccacgcgccggtgcctttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggccaattctttcccaccgacctttggtcaaggtacgaaagttgaaattaaa

SEQ ID NO: 632 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgttaccacgcgccggtgcctttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggcctattctccaccaccgacctttggtcaaggtacgaaagttgaaattaaa

SEQ ID NO: 633 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgttaccacgcgccggtgcctttgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtctaattctccaccaccgacctttggtcaaggtacgaaagttgaaattaaa

SEQ ID NO: 634 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgcggtttatacttcggtccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctctgttatcttctagcctggtggttttcggtcaaggcacgaaagtggaaatcaaa

SEQ ID NO: 635 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgcggtttatacttcggtccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtaattcttgggatagccgcggcggtcacttagtggtgtttggtcaaggtacgaaagttgaaattaaa

SEQ ID NO: 636 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgcggtttatacttcggtccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggattattctagcgacttacacgtggtgtttggtcaaggtacgaaagttgaaattaaa

SEQ ID NO: 637 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgcggttcttacttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagcacgccgtctgttgtttttggccagggtacgaaggttgaaatcaaa

SEQ ID NO: 638 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgtcttctggttctacggccgcgccgatcggttattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgccgcgtgggacgactctggcggcagcccagttttcggtcagggtaccaaagtggagatcaaa

SEQ ID NO: 639 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacggttggtccatacggtcgcacctatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacaggccaactctccgccgattacgttcggtcaaggcacgaaagtggaaatcaaa

SEQ ID NO: 640 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcccgcggtggttacaagaccgcggacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcctggtttgggattcttcttctgatcatgtgatcttcggtcaaggcacgaaagtggaaatcaaa

SEQ ID NO: 641 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcccgcggtggttacaagaccgcggacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatattacggtaacccgcataccttcggtcaaggtaccaaggtggaaattaaa

SEQ ID NO: 642 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcccgcggtggttacaagaccgcggacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatgacaactctctgcgtggctctaaggttttcggccaaggcaccaaagttgagatcaaa

SEQ ID NO: 643 - DNA, 786 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcccgcggttcttacacgagctgggtggactctccgtacccggcgagcgcccgctactatatggatgtgtggggccaatggggtcaaggtacgctggttacggtgagcagcggtggcagctctcgtagcagctctagcggcggtggcggcagcggcggcggcggcgaaatcgttctgacgcaaagcccggcgacgctgtctttatctccgggtgagcgcgcgacgctgtcttgccgcgcgagccaatctgtgtctagctcttacctggcgtggtatcaacagaagccaggtcaggccccacgcttactgatttatggtgcgagcagccgcgcgaccggcatcccagcgcgtttttctggtagcggctctggtacggatttcacgctgacgatttctcgtctggagccggaggacttcgcggtgtattactgtcaaacgtggggcacgggcattcgtgttttcggtcagggtacgaaagttgaaattaaa

SEQ ID NO: 644 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttggttggaacggtggtaaccacggcgcgttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccgccaggccatgcgctggccagtggcgtttggtcaaggtacgaaagttgaaattaaa

SEQ ID NO: 645 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttggttgggtttctgccccagaggcgctggccacgaccccactggattattggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtatgcaagcgctgcagccaccaatcacgtttggtcagggcaccaaggttgagattaaa

SEQ ID NO: 646 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttggttacgcctctgccggttatcagatcgaccattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactcttctgcgagcccgtacgttttcggtcagggtaccaaagtggagatcaaa

SEQ ID NO: 647 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttttaccaatgaagttattacgcggcgaattctactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactcttctgcgggcgtgttcggtcaaggtaccaaggtggaaattaaa

SEQ ID NO: 648 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttccaggtcgcacgcgctactttgattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtctaattctttcccaccgacctttggtcaaggtacgaaagttgaaattaaa

SEQ ID NO: 649 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttcgctctggttactcttctagccagccagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgttacctgggactcttctctgagcgtgtacgttttcggtcagggtaccaaagtggagatcaaa

SEQ ID NO: 650 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttacgtctcgcgacggttacggcatgggcgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctaccctggtggccttcggtcaaggcacgaaagtggaaatcaaa

SEQ ID NO: 651 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttggggtgactctgaggttggtaacgcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataactcttacccgccgaccttcggtcaaggtaccaaggtggaaattaaa

SEQ ID NO: 652 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcctatgacgactctctgctgaatccaggtaagatctttggtcagggcaccaaggttgagattaaa

SEQ ID NO: 653 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggatcgctcttctctggtggtgttcggtcaaggtaccaaggtggaaattaaa

SEQ ID NO: 654 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttcttctagcgtggtgttcggtcaaggtaccaaggtggaaattaaa

SEQ ID NO: 655 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctccaccgccgaccttcggtcaaggtaccaaggtggaaattaaa

SEQ ID NO: 656 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatggttcttctccgcgtaccttcggtcaaggtaccaaggtggaaattaaa

SEQ ID NO: 657 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatattactctgccccgccgtatacgttcggtcaaggcacgaaagtggaaatcaaa

SEQ ID NO: 658 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatgactcttctctgctgagcggtcacgaggtttttggtcagggcaccaaggttgagattaaa

SEQ ID NO: 659 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtgggattctttcggtcaggtgtttggtcaaggtacgaaagttgaaattaaa

SEQ ID NO: 660 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgacggtggtggttaccgctcttatggccaatctatgtattacatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtggtgcctgggatagccgttctaacgtttacgtgttcggccagggcacgaaggttgaaatcaaa

SEQ ID NO: 661 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgagggttaccgcacggaccgcaaatattggttagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactcttctaatctgagcgccggtgttttcggccaaggcaccaaagttgagatcaaa

SEQ ID NO: 662 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgagggttaccgcacggaccgcaaatattggttagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctagcgatcatacggttttcggtcagggtaccaaagtggagatcaaa

SEQ ID NO: 663 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcttattagactacggtgagacgggctattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctcgttctgaccactgggtgtttggccaaggtacgaaggtggagattaaa

SEQ ID NO: 664 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagctctatcgccgcccgccgctacggctatggtatggacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtctgactctccgccgattacgttcggtcaaggcacgaaagtggaaatcaaa

SEQ ID NO: 665 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcacgggtgttaactaccgccgccgtgcgttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaagccacacgtctcgtacccaggttgttttcggtcagggtaccaaagtggagatcaaa

SEQ ID NO: 666 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgttccacgcacgtactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtggtacctgggacgattctagcggcggtcgtgttttcggtcagggcaccaaggttgagatcaaa

SEQ ID NO: 667 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccgagcaaccaaacggtggttggccactggattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctaccctggtgttcggtcaaggtaccaaggtggaaattaaa

SEQ ID NO: 668 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcgactcttctggctatatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttctacggcggaagtgttcggtcaaggtaccaaggtggaaattaaa

SEQ ID NO: 669 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgggtgatggcagcttatctggtgttgtgttcggccagggcacgaaggttgaaatcaaa

SEQ ID NO: 670 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcaccaatacgggtgttttcggccaaggcaccaaagttgagatcaaa

SEQ ID NO: 671 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtatctctgttgccggtaagtattattactactatatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccgccaaggtaaacatggcccatggaagttcggtcagggtaccaaagtggagatcaaa

SEQ ID NO: 672 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttctggttggccagttcactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcaggtttgggattctagcagcgaccatgttttattcggccagggcacgaaggttgagattaaa

SEQ ID NO: 673 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtcttactctccgccgccgacgttcggtcaaggcacgaaagtggaaatcaaa

SEQ ID NO: 674 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacggttctagcccgagctactctttcggtcagggtaccaaagtggagatcaaa

SEQ ID NO: 675 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacggttctagcagcccgacgttcacgttcggccaaggcaccaaagttgagatcaaa

SEQ ID NO: 676 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacggtacgagcccgaatacgttcggtcaaggcacgaaagtggaaatcaaa

SEQ ID NO: 677 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacaacaacccgagctggaccttcggtcaaggtaccaaggtggaaattaaa

SEQ ID NO: 678 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggacgactctaccggcaattacgttttcggtcagggtaccaaagtggagatcaaa

SEQ ID NO: 679 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccccacaagtttctggtttaaactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctttaagcggcccgcacgttgttttcggccaaggcaccaaagttgagatcaaa

SEQ ID NO: 680 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccccacaagtttctggtttaaactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacggcggttcttctccggtggtgttcggtcaaggtaccaaggtggaaattaaa

SEQ ID NO: 681 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtttagataacgagtctgacttctggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtggtagctgggacagcggtctgcaggactttgttttcggtcagggcaccaaggttgagatcaaa

SEQ ID NO: 682 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtatgcgccattactcttctggtccacgcgccgtggattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctccaccaattacctttggtcaaggtacgaaagttgaaattaaa

SEQ ID NO: 683 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtcgcaccgacaagcgcatggactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagcgtgggacagctctaccagctcttgggtgttcggtcaaggcaccaaagttgagatcaaa

SEQ ID NO: 684 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctaaaggtcactctacgatgcaatacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaagcgggccaatggccgcgcacgttcggccagggcacgaaggttgagattaaa

SEQ ID NO: 685 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctcgtgaccgcccagtttactctgacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggatagctctggcgacgttgtttttggccagggtacgaaggttgaaatcaaa

SEQ ID NO: 686 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctaccggtcgcgcccgcgttgttgactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagcgcccatgttgttttcggccagggcacgaaggttgagattaaa

SEQ ID NO: 687 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtggtttaggttggaagatcgagccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcagcccaagcgttgttttcggccagggcacgaaggttgagattaaa

SEQ ID NO: 688 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtggtttaggttggaagatcgagccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagcgtgggacagcaccccagcggttgttttcggccagggcacgaaggttgagattaaa

SEQ ID NO: 689 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtggtttaggttggaagatcgagccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaaacctggggtaccggcatccaggttgttttcggccagggcacgaaggttgagattaaa

SEQ ID NO: 690 - DNA, 783 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtcacgtttcttggtacggtgactctgcgatttactactattactatggccagccatacggtatggattattggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtcaagcctgggacacctctcatgtggtgttcggtcaaggcacgaaggtggagattaaa

SEQ ID NO: 691 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgaccgcccgctaccgcggttcttcttggccgagcaacatgcactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactcttctagcctgacctctggtgttttcggccaaggcaccaaagttgagatcaaa

SEQ ID NO: 692 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgaccggtgccttcgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagtgtgggacagctctagcgatcacctggttgttttcggccagggcacgaaggttgagattaaa

SEQ ID NO: 693 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttggcgaccacggtttcgttcaccactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgctctagctacaccagctctagctctgaggtttttggccagggtacgaaggttgaaatcaaa

SEQ ID NO: 694 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaaagaccaacgccaaacgtggtctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtcagtattacagctctcaaacgtttggccagggtacgaaggttgaaatcaaa

SEQ ID NO: 695 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaaaaagcaccgcccaccagttaacggcgcgtcttacctgggtagctggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcagcgaccactgggttttcggccaaggcaccaaagttgagatcaaa

SEQ ID NO: 696 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaataacaacacgggttgggccttcgacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagcaattctccgccaatcacgtttggccagggtacgaaggttgaaatcaaa

SEQ ID NO: 697 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatggtagctcttctccaatgtatacctttggtcaaggtacgaaagttgaaattaaa

SEQ ID NO: 698 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataacagctacccatggacgtttggccagggtacgaaggttgaaatcaaa

SEQ ID NO: 699 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataacacctacccatggacgtttggccagggtacgaaggttgaaatcaaa

SEQ ID NO: 700 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtattacaattacccatggacgtttggccagggtacgaaggttgaaatcaaa

SEQ ID NO: 701 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtattacagctctccaccagtgagctttggtcaaggtacgaaagttgaaattaaa

SEQ ID NO: 702 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagcccggacagctctggtaactgggtgtttggccaaggtacgaaggtggagattaaa

SEQ ID NO: 703 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgaccgcaactactaccgctcttattggaaaggtgacgtgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtaactctagcgatagctacggtggtaacaccgttgtgtttggccaaggtacgaaagttgagattaaa

SEQ ID NO: 704 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgactctggtggttaccgcgaccagccgggttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatatgattttacgccaccaacgtttggtcagggcaccaaggttgagattaaa

SEQ ID NO: 705 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgactacgactactctcaagttggccattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctaccacggaccgcgtgtttggccaaggtacgaaggtggagattaaa

SEQ ID NO: 706 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgagggtttctctggtacgtggacggcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagaagactctccaccgattaccttcggtcaaggtaccaaggtggaaattaaa

SEQ ID NO: 707 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcacgccttcttctacggttactatcaggacgacgcgttcgatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtggtacgtgggatagcagccgcttaccagcctatgtttttggccagggtacgaaggtggagatcaaa

SEQ ID NO: 708 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtatcttattcggtttcaagggtatggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggatcgcagcacggacttagtggtgtttggtcaaggtacgaaagttgaaattaaa

SEQ ID NO: 709 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtaagggtcgctctgttcgcggtgcggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctgaccattgggtgtttggtcaaggtacgaaagttgaaattaaa

SEQ ID NO: 710 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtttaggtacggccgttaacacgagcctgttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagaacgacacgagcccgcgtacgttcggtcaaggcacgaaagtggaaatcaaa

SEQ ID NO: 711 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtggcacgtgggattctagcagctctcatttaaaggtttttggccagggtacgaaggttgaaatcaaa

SEQ ID NO: 712 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtaaccgcggttggcaacaattcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtctctggattctggcttaaagtcttgggtgtttggccaaggtacgaaggtggagattaaa

SEQ ID NO: 713 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtccattatcttggggtgcctactaccgtgcgttagacgattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactctccgctgccgacgttcggtcaaggcacgaaagtggaaatcaaa

SEQ ID NO: 714 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcgcccacgctggttcgactctgcctattatgccccatttgagaattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgagacgtgggacagccgtcgtaacgccgttgtttttggtcagggcaccaaggttgagattaaa

SEQ ID NO: 715 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcgcccacgctggttcgactctgcctattatgccccatttgagaattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaacgcagcaaatggccgttaatcttcggtcagggtaccaaagtggagatcaaa

SEQ ID NO: 716 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaccgactcttacacggccacggccccggatcactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggactattctccaccaccgacctttggtcaaggtacgaaagttgaaattaaa

SEQ ID NO: 717 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggccaagaacggtgcctctttaggcgtgaacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttcttctccgagcggctacgttttcggtcagggtaccaaagtggagatcaaa

SEQ ID NO: 718 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggccaagaacggtgcctctttaggcgtgaacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatgaccgctctcgtcgtggcgttgttttcggtcagggtaccaaagtggagatcaaa

SEQ ID NO: 719 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggccaagaacggtgcctctttaggcgtgaacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtgggatacgtctacggtggtgtttggtcaaggtacgaaagttgaaattaaa

SEQ ID NO: 720 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgcggccaagaacggtgcctctttaggcgtgaacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtggggcccaggtatccatgtggtgttcggtcaaggtaccaaggtggaaattaaa

SEQ ID NO: 721 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtgccgcgtgggacgattctaataatgacccggttttcggtcagggcaccaaggttgagatcaaa

SEQ ID NO: 722 - DNA, 729 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaccagtacgattctagcccggagaccttcggtcaaggcaccaaagttgagatcaaa

SEQ ID NO: 723 - DNA, 729 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaacagtacggcacggcgccgatcgcgttcggtcaaggcaccaaagttgagatcaaa

SEQ ID NO: 724 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgttacagctgggacagcacggataccgttgtgttcggtcaaggcaccaaagttgagatcaaa

SEQ ID NO: 725 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatacggcctactctttaccaggtgatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccactgggtgtttggccaaggtacgaaggtggagattaaa

SEQ ID NO: 726 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatacggcctactctttaccaggtgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggataacaattctgacttatgggtgtttggccaaggtacgaaggtggagattaaa

SEQ ID NO: 727 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccggcgttggtcgcatcttcccatactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtcttatagcacgccgttaacgttcggccagggcacgaaggttgagattaaa

SEQ ID NO: 728 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccggtgccgtttggttagactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgcggtacctgggacggcggccgcggcacgggtgtttttggccagggtacgaaggttgaaatcaaa

SEQ ID NO: 729 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctcttctaaggtggtgtttggtcaaggtacgaaagttgaaattaaa

SEQ ID NO: 730 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacgacgccgttttgggtgttcggtcaaggtaccaaggtggaaattaaa

SEQ ID NO: 731 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtcaagtgtttggccaaggtacgaaggtggagattaaa

SEQ ID NO: 732 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccgcccgtgatgattctttaaacggtccgtgggtttttggccagggtacgaaggtggagatcaaa

SEQ ID NO: 733 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatattatagcccaccaccatacaccttcggccagggcacgaaggttgaaatcaaa

SEQ ID NO: 734 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctctttatctggtagcgtttttggccagggtacgaaggtggagatcaaa

SEQ ID NO: 735 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaacgttatggacctttggccaaggtacgaaggtggagattaaa

SEQ ID NO: 736 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacatctcttcttggtacaagtctggcgcgttcggttattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccacgcgtgggactctttcaccgcgagcgttttcggtcaaggcacgaaagtggaaatcaaa

SEQ ID NO: 737 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaggtacgggtttcatgcaaggctattgggccttagattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaacgctctaattggccgctgacgttcggtcaaggcacgaaagtggaaatcaaa

SEQ ID NO: 738 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgcttctctggtgtttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctacgccacgtacctttggtcaaggtacgaaagttgaaattaaa

SEQ ID NO: 739 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgcttctctggtgtttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctttacatcgtgtgttcggtcaaggtaccaaggtggaaattaaa

SEQ ID NO: 740 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgcttagttcgcgttctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgaaacctggacgaatacgtacacgcgttatgtgttcggtcaaggtaccaaggtggaaattaaa

SEQ ID NO: 741 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcggcgtgggacgattctttaaacccgtatgtgttcggtcaaggtaccaaggtggaaattaaa

SEQ ID NO: 742 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttattaagcctgctggttgttttcggtcagggtaccaaagtggagatcaaa

SEQ ID NO: 743 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagcaagacggttgtgtttggccaaggtacgaaggtggagattaaa

SEQ ID NO: 744 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactattctccaccaccgtataccttcggtcaaggtaccaaggtggaaattaaa

SEQ ID NO: 745 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagcgccgattcttctgccggctttgtggttttcggtcaaggcacgaaagtggaaatcaaa

SEQ ID NO: 746 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgggtacgtggacgttagatctgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccaccatacacctttggccaaggtacgaaggtggagattaaa

SEQ ID NO: 747 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacccatctcaaaagtactactttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactataactggccacaaacctttggccaaggtacgaaggtggagattaaa

SEQ ID NO: 748 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgcccaggtccagcctgtaatcgttaccacaattacggctgcaatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggtgtggaattcttcttctgaccattgggtttttggccagggtacgaaggtggagatcaaa

SEQ ID NO: 749 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgccgcggtgccggttactattatttcgaccattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactctaccccgctgacgttcggtcaaggcacgaaagtggaaatcaaa

SEQ ID NO: 750 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgccgcaactggccacgcggttattttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttctacggtggtgtttggtcaaggtacgaaagttgaaattaaa

SEQ ID NO: 751 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgccgcaactggccacgcggttattttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagtcttatacgggtggtagcagctatgttttcggtcaaggcacgaaagtggaaatcaaa

SEQ ID NO: 752 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgagacgtgggacagcgatacctacgttttcggtcagggtaccaaagtggagatcaaa

SEQ ID NO: 753 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtgcctgggacaatagccgtcacccagaggtttttggtcagggcaccaaggttgagattaaa

SEQ ID NO: 754 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcagcacgttcgttttcggccaaggcaccaaagttgagatcaaa

SEQ ID NO: 755 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgatagcccgccaatcacgttcggccaaggcaccaaagttgagatcaaa

SEQ ID NO: 756 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaatcacgttcggccaaggcaccaaagttgagatcaaa

SEQ ID NO: 757 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaatcttacgatacccatttatctggtccaattttcggccagggcacgaaggttgaaatcaaa

SEQ ID NO: 758 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgttgcctgggacgatagcctgaacggttacgtttttggtcagggcaccaaggttgagattaaa

SEQ ID NO: 759 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctccaccaccgacctttggtcaaggtacgaaagttgaaattaaa

SEQ ID NO: 760 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctaccccgtatgttgttttcggtcagggtaccaaagtggagatcaaa

SEQ ID NO: 761 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttcttatcttctgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctgtgaaggagcaagtggtgtttggtcaaggtacgaaagttgaaattaaa

SEQ ID NO: 762 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtaaggactacttcacgacgggctatcaagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactctgcgaccccgccaacgttcggtcagggtaccaaagtggagatcaaa

SEQ ID NO: 763 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttctacgttaggtggttcttttgataactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcaggcctattctccaccaattacctttggtcaaggtacgaaagttgaaattaaa

SEQ ID NO: 764 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaatctggcgccgctacttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacaggccaatagcttcccgccaacgttcggccagggcacgaaggttgagattaaa

SEQ ID NO: 765 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgccacgacgccttatgggccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcaacagccgtgacagcacggacaaccatcaggcggttttcggtcaaggcacgaaagtggaaatcaaa

SEQ ID NO: 766 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctggttctatctggtactacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctaatacggccaactgggtgtttggccaaggtacgaaggtggagattaaa

SEQ ID NO: 767 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctaacgccgccacgggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctgccccaattacctttggtcaaggtacgaaagttgaaattaaa

SEQ ID NO: 768 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagttatcccagagaaggttgccggcctggactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggtttgggattcttctacgaatcatgtggttttcggtcaaggcacgaaagtggaaatcaaa

SEQ ID NO: 769 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagttaacatcggtttatacggtgtggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacccgccgcaacacctatgtgttcggtcaaggtaccaaggtggaaattaaa

SEQ ID NO: 770 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccctggagaagcaagccccaggtgccccgggcatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatgacacgttaccgattaccttcggtcaaggtaccaaggtggaaattaaa

SEQ ID NO: 771 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaattaccactgggacgactcttctgacggccgtatcttcgatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagacgtggggttcttgggtgtttggccaaggtacgaaggtggagattaaa

SEQ ID NO: 772 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtggttctggttctttctatcgtttattcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtctgcaacacaacagctatccgttcacgttcggtcagggtaccaaagtggagatcaaa

SEQ ID NO: 773 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccaactacggtttcgactacggcagcacgtactattctggcaatggcttcgactactggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagcaatcttactctacccgctatacctttggtcaaggtaccaaggttgaaatcaaa

SEQ ID NO: 774 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcctctgccgacgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtgaaacgtgggattcttttcatacggtgttcggtcaaggcaccaaagttgagatcaaa

SEQ ID NO: 775 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccgcctacggtgacgttgtgcgtccagcctttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcttacaacacaatagctatccattaacgttcggccaaggcaccaaagttgagatcaaa

SEQ ID NO: 776 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccggttctggtttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagctctccgggtttcgtttttggccagggtacgaaggttgaaatcaaa

SEQ ID NO: 777 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgccacgatcttaggtttagatgcgcacggtcatggttttgatcattggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagtatggctcttggccaccatcttttacgtttggccagggtacgaaggtggagatcaaa

SEQ ID NO: 778 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatcttatagcccgccaccaacgttcggccaaggcaccaaagttgagatcaaa

SEQ ID NO: 779 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtggtgacgttatgccattcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcaagcagtatgacagcttcccaatcacctttggccaaggtacgaaggtggagattaaa

SEQ ID NO: 780 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtggtgttgccgccgttgatgattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctacgctggtggtgttcggtcaaggtaccaaggtggaaattaaa

SEQ ID NO: 781 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtttaaagggttacttcggccattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttcttctggcctggtggttttcggtcaaggcacgaaagtggaaatcaaa

SEQ ID NO: 782 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttctacgacgggtatcagctggggctacggtctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgttggttgggacggcagcctgtctggtgaggtttttggtcagggcaccaaggttgagattaaa

SEQ ID NO: 783 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtataacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgactctatcaatcgcgatgtggtgttcggtcaaggcacgaaggtggagattaaa

SEQ ID NO: 784 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcggcgcgtgggactctcgctctaatgtttatgtgtttggtcaaggtaccaaggttgaaatcaaa

SEQ ID NO: 785 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcggcacctgggactcttctttaagcgccggcgtgtttggtcaaggtaccaaggttgaaatcaaa

SEQ ID NO: 786 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggcgtgggactctcgcacggtggtttttggccagggtacgaaggtggagatcaaa

SEQ ID NO: 787 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacaagggtggtatgtacggtttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcaagcagtatgacagcttcccaatcacctttggccaaggtacgaaggtggagattaaa

SEQ ID NO: 788 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaggtggtcgcttcacgtattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaacatagctctccgccaatcacgtttggccagggtacgaaggttgaaatcaaa

SEQ ID NO: 789 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaccaggttacttaacgtttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcgcagcaactctccaggcgtgaccttcggtcaaggtaccaaggtggaaattaaa

SEQ ID NO: 790 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggtgcctggggtccaggcggcttcgacgtgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactacacgaccccggtgacgttcggtcaaggcacgaaagtggaaatcaaa

SEQ ID NO: 791 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttaacgggttaccgctctcgtagctaccaatgggatggtatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgcctcttgggatgatagcttaaactctggttgggtgttcggccagggcacgaaggttgaaatcaaa

SEQ ID NO: 792 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttatacgccatcggtgccggcatggatccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtcaagtgtttggccaaggtacgaaggtggagattaaa

SEQ ID NO: 793 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacatggccggttacaactggatcgacttttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtgcggcctgggatgattctctgaacttaccagtgtttggccaaggtacgaaggtggagattaaa

SEQ ID NO: 794 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccacgcggttggggttacgcctatggcgacttctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcctgggattcttcttctggccgtcgttgggttttcggtcaaggcacgaaagtggaaatcaaa

SEQ ID NO: 795 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggtcacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctctgccacgcacgtttggccagggtacgaaggttgaaatcaaa

SEQ ID NO: 796 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccaaggttactacggtggtagccgtgcctctgaatactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatactacaatccgccgcaaacgttcggtcagggtaccaaagtggagatcaaa

SEQ ID NO: 797 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcgccggtgacggtatggacggctggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagtcttatgattctagcttaaacccatatgtggtgttcggtcaaggtaccaaggtggaaattaaa

SEQ ID NO: 798 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtcgcgacggttatggcatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagcggacaacttcccgctgaccttcggtcaaggtaccaaggtggaaattaaa

SEQ ID NO: 799 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtcgcgacggttatggcatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagaagacaactacccgctgaccttcggtcaaggtaccaaggtggaaattaaa

SEQ ID NO: 800 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtcgcgacggttatggcatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagaagactctccaccgctgaccttcggtcaaggtaccaaggtggaaattaaa

SEQ ID NO: 801 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtggtcgcgacggttatggcatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctccaccgccgaccttcggtcaaggtaccaaggtggaaattaaa

SEQ ID NO: 802 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggtacgttcccattatttgattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcagctacgcggacggtcgctatgtgtttggtcaaggtacgaaagttgaaattaaa

SEQ ID NO: 803 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcaccaaccacgttgtttttggtcagggcaccaaggttgagattaaa

SEQ ID NO: 804 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgatagcccgccaatcacgttcggccaaggcaccaaagttgagatcaaa

SEQ ID NO: 805 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcgagctacaccccatctcgcaatacctatgttttcggtcaaggcacgaaagtggaaatcaaa

SEQ ID NO: 806 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagccgcacggttgtgtttggccaaggtacgaaggtggagattaaa

SEQ ID NO: 807 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctatctgggtttttggccagggtacgaaggttgaaatcaaa

SEQ ID NO: 808 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacggttgtgtttggccaaggtacgaaggtggagattaaa

SEQ ID NO: 809 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctgggacagcttcggtcaagtgtttggccaaggtacgaaggtggagattaaa

SEQ ID NO: 810 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattctatgtctggttggatttttggccaaggtacgaaggtggagattaaa

SEQ ID NO: 811 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagcttcggtttagtgtttggccaaggtacgaaggtggagattaaa

SEQ ID NO: 812 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcccatggatgtacccagacttatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatcactgggttttcggccagggcacgaaggttgagattaaa

SEQ ID NO: 813 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctctgacggccgtttttggccagggtacgaaggttgaaatcaaa

SEQ ID NO: 814 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcacgggtatcacgggttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctgccacggtggtgtttggtcaaggtacgaaagttgaaattaaa

SEQ ID NO: 815 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctccaccgccaacctttggccaaggtacgaaagttgagattaaa

SEQ ID NO: 816 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacaacaactggccaccgccacgtacctttggtcaaggtaccaaggttgaaatcaaa

SEQ ID NO: 817 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctcactactacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtagctcttttaccccaagctctacgttcgtggtgtttggtcaaggtacgaaagttgaaattaaa

SEQ ID NO: 818 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctaagggttacttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaagaagattctccgccaatcacgtttggccagggtacgaaggttgaaatcaaa

SEQ ID NO: 819 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgttggtgttggtgccacggattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaccaatcacctttggccaaggtacgaaggtggagattaaa

SEQ ID NO: 820 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaggccggttactacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatatgattctccgccattaacgtttggccagggtacgaaggttgaaatcaaa

SEQ ID NO: 821 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagggtgccacgggtacgttacagggcgccgcccagtacggcatggatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagtataataacccaccagttaccttcggccagggcacgaaggttgaaatcaaa

SEQ ID NO: 822 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagatcggtaacgtttactacggctttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagcgactctccaccgattaccttcggtcaaggtaccaaggtggaaattaaa

SEQ ID NO: 823 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagccgtctgttatctggtggtatgtttggtcagggcaccaaggttgagattaaa

SEQ ID NO: 824 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgttatctgcctgggtttttggtcagggcaccaaggttgagattaaa

SEQ ID NO: 825 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagccgtaccggtgttttcggtcagggtaccaaagtggagatcaaa

SEQ ID NO: 826 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcagcaccgttgttttcggtcagggtaccaaagtggagatcaaa

SEQ ID NO: 827 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgatagcccgccattaacgttcggccaaggcaccaaagttgagatcaaa

SEQ ID NO: 828 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcttccaaacgatctcttataccacgggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcagcgaccacgaccacgtggtttttggccagggtacgaaggtggagatcaaa

SEQ ID NO: 829 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgcggtgttacgcgcccattttattactctggctacggcatggatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagtatgcgtctccaccagttagcttcggccagggcacgaaggttgaaatcaaa

SEQ ID NO: 830 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcgctacaactactctcgcggcaaattaggtattccagcgatggatatttggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacagtatgataacttaccaatcaccttcggccagggcacgaaggttgaaatcaaa

SEQ ID NO: 831 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagtggggtggttcttggttcggtatggacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaagcgtattctccgccagttacgtttggccagggtacgaaggttgaaatcaaa

SEQ ID NO: 832 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttccgctcttctaaccgcggttttgatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtatgcagggcacgcattggccaccaacgtttggccagggtacgaaggttgaaatcaaa

SEQ ID NO: 833 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggttaccgcgactggttaaagcagagctactactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtgggacagccgtctgaactctgccgtttttggtcagggcaccaaggttgagattaaa

SEQ ID NO: 834 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaaggcctggggttggttcgacccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtacgatagcacgccgtacacgttcggccagggcacgaaggttgagattaaa

SEQ ID NO: 835 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaaggcctggggttggttcgacccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtacaataattggccatatacgttcggtcagggcaccaaggttgagatcaaa

SEQ ID NO: 836 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaagtctttaggtgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcccaccaatcacctttggccaaggtacgaaggtggagattaaa

SEQ ID NO: 837 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaagcgtgggatagctcttctgcctacgtgttcggccagggcacgaaggttgaaatcaaa

SEQ ID NO: 838 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccataccgccgctcttactttagctacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaagacaacaatctgccgatcacgttcggtcagggtaccaaagtggagatcaaa

SEQ ID NO: 839 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccataccgccgctcttactttagctacggtatggatgtttggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaagagaacagcccgccggttacgttcggtcagggtaccaaagtggagatcaaa

SEQ ID NO: 840 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctctgtttactactaccagccgttcgacctgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactctaccccgtttacgttcggtcaaggcacgaaagtggaaatcaaa

SEQ ID NO: 841 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagcacgcaccgcgtttttggtcagggcaccaaggttgagattaaa

SEQ ID NO: 842 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatataatacctacggtacgttcggccaaggcaccaaagttgagatcaaa

SEQ ID NO: 843 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgttcttcttatattagcggtacgacgcacgtgatctttggccagggtacgaaggtggagatcaaa

SEQ ID NO: 844 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgttggtgcccgctcttctaatctggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccgtcaaggcgcccactggccatgggcgtttggccaaggtacgaaggtggagattaaa

SEQ ID NO: 845 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgccgccgactactctttcagctatccatacgcgtcttatatggatccgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaagcgtgggatagctcttctatcgttgtgttcggccagggcacgaaggttgaaatcaaa

SEQ ID NO: 846 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtgactactacgactctagcggccgcgttggctactatggcgcgttcgacatctggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagcaagccaactctccgccaattacctttggtcaaggtaccaaggttgaaatcaaa

SEQ ID NO: 847 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtatcgccttaccaacggcgatggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgataacccaccagtgacctttggtcaaggtacgaaagttgaaattaaa

SEQ ID NO: 848 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacggtgtttctggttcttcttatggcgccttcgatatctggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggcctgggactctagcagcattgttgttttcggtcagggtaccaaagtggagatcaaa

SEQ ID NO: 849 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccactaccgctcttctacgcgtagccacggttttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatctgataataatccaatcacgttcggccaaggcaccaaagttgagatcaaa

SEQ ID NO: 850 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccactactacggttctggttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacgataacccaccagtgagctttggtcaaggtacgaaagttgaaattaaa

SEQ ID NO: 851 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacatccgcggtggtatgaacgtttggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgcggtacctgggacagcagctctagcccaggtggtgtgtttggccaaggtacgaaggtggagattaaa

SEQ ID NO: 852 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccaaacggaccgcttatctagcggctactactatccagtgtatatggatttatggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcagacctgggattcttctacgggtgtgttcggccagggcacgaaggttgaaatcaaa

SEQ ID NO: 853 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggtggtggttacggtcattatatggacgtttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtgggattcttctacggcggtgtttggtcaaggtacgaaagttgaaattaaa

SEQ ID NO: 854 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacgttacgttatcttcttggtacagcattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctgccctgctggaagttttcggtcaaggcacgaaagtggaaatcaaa

SEQ ID NO: 855 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactactcttcttctccagccggcgatttctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcgacctgggacgattctttaaacggcccggtgttcggtcaaggtaccaaggtggaaattaaa

SEQ ID NO: 856 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcactactctgttatgtgggacaagccagtgtatatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtgggattctacgacgcatgtggtgttcggtcaaggtaccaaggtggaaattaaa

SEQ ID NO: 857 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatccgctactggtcttaccaagacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggattattctcgtaacaactgggtttttggccagggtacgaaggttgaaatcaaa

SEQ ID NO: 858 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaagttcgttggtgcctcttctacctttgactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctacgccgccgtggaccttcggtcaaggtaccaaggtggaaattaaa

SEQ ID NO: 859 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaggtggtcgcgacggttactttattcgcaagggcgcctttgatatttggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaacattataataactggccaccaacgtttggtcagggcaccaaggttgagattaaa

SEQ ID NO: 860 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaggttcttggtacgccggttacggcgcgatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttctgccgcggtggtgttcggtcaaggtaccaaggtggaaattaaa

SEQ ID NO: 861 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttattatctacgtctaactggttcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctttggtggcaacaacaactggatttttggccaaggtacgaaggtggagattaaa

SEQ ID NO: 862 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttattatggtctcgcacgggtcaccgttttgactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaacgttctaacccaccgggctatacgttcggtcaaggcacgaaagtggaaatcaaa

SEQ ID NO: 863 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttacgcggttcttactaccgcaattggtttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctggtctgccgtatgttttcggtcaaggcacgaaagtggaaatcaaa

SEQ ID NO: 864 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaacgcgcgcccaacaatctagcagcgcctaccgtttacgtagcagctactacatggacccgtggggccagtggggccaaggtacgttagttaccgtttctagcggcggctctagccgttctagcagcagcggtggcggcggtagcggcggcggcggcgaaattgtgttaacgcagtctccagcgaccctgtctctgtctccaggtgaacgcgccacgctgtcttgccgcgcgtctcagagcgtttctagctcttatttagcctggtatcagcagaagccgggtcaagccccgcgcttattaatctatggcgcgtctagccgtgcgacgggcattccggcccgctttagcggctctggtagcggcacggacttcaccttaacgatttctcgtttagaaccggaggatttcgccgtttattattgccaacaattagaccgttacccgccgaccttcggtcaaggcacgaaggtggagattaaa

SEQ ID NO: 865 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaacgtctgaccactcttactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttggcatagcggtgataaccgctgggtttttggccagggtacgaaggttgaaatcaaa

SEQ ID NO: 866 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatggaccgcgttggttctcgcggttatacctactacagcacgctgggcagctacgccatggacatttggggccagtggggccaaggtacgttagttaccgtttctagcggcggctctagccgttctagcagcagcggtggcggcggtagcggcggcggcggcgaaattgtgttaacgcagtctccagcgaccctgtctctgtctccaggtgaacgcgccacgctgtcttgccgcgcgtctcagagcgtttctagctcttatttagcctggtatcagcagaagccgggtcaagccccgcgcttattaatctatggcgcgtctagccgtgcgacgggcattccggcccgctttagcggctctggtagcggcacggacttcaccttaacgatttctcgtttagaaccggaggatttcgccgtttattattgccaacaagcctacagcccaccgattaccttcggtcaaggcacgaaggtggagattaaa

SEQ ID NO: 867 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgggtggtggtaacgactctggtgcgtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatgactctccaccggtgaccttcggtcaaggtaccaaggtggaaattaaa

SEQ ID NO: 868 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgggtcaacactcttacggtaagaatagcttcgccgtgtacatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatttgatgatttaccaatcacgtttggtcagggcaccaaggttgagattaaa

SEQ ID NO: 869 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgaagacgcgcaaggactggttcgacccgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctctgccatctgttgtgtttggccaaggtacgaaggtggagattaaa

SEQ ID NO: 870 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtgcgtcttattctaccggctctaccttatacgtttttggccagggtacgaaggttgaaatcaaa

SEQ ID NO: 871 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatgcaacgctacggtatggacgtttggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagacgtgggattcttttggccaagtgttcggtcaaggcaccaaagttgagatcaaa

SEQ ID NO: 872 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaacggtcgcacggttacgaagggcatggatgtttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttattctccaccaccgacctttggtcaaggtacgaaagttgaaattaaa

SEQ ID NO: 873 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaacggttctttaggtttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaagcgtattctccgccaatcacgtttggccagggtacgaaggttgaaatcaaa

SEQ ID NO: 874 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcggttggacgggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccaccaacctttggccaaggtacgaaggtggagattaaa

SEQ ID NO: 875 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcaactactctgccggttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacggctcttctccaatgattacctttggtcaaggtacgaaagttgaaattaaa

SEQ ID NO: 876 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcgttccaaagtacccaatggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaatgtgggatagctctagcgaccactctgtgtttggccaaggtacgaaggtggagattaaa

SEQ ID NO: 877 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaccgcgttccaaagtacccaatggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccacgtggtgtttggtcaaggtacgaaagttgaaattaaa

SEQ ID NO: 878 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaatacatctctggtggttacagctattcttctcgtttaagctatggcatggacccatggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggccaactctccaccgatcacctttggccaaggtacgaaagttgagattaaa

SEQ ID NO: 879 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaatacatctctggtggttacagctattcttctcgtttaagctatggcatggacccatggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctccaccggttacctttggccaaggtacgaaagttgagattaaa

SEQ ID NO: 880 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcttagtttcttctgactctccgtatttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctagcagcacccgcgttttcggtcagggtaccaaagtggagatcaaa

SEQ ID NO: 881 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcccagcccgctcttctcaaggccgtccaatcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggtttgggactctagcagcgatcactgggttttcggtcagggtaccaaagtggagatcaaa

SEQ ID NO: 882 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctggtcaatacgccggtttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccattaacctttggccaaggtacgaaggtggagattaaa

SEQ ID NO: 883 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctttaaacggtggtgccggtgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgtacagcccaccaatcacctttggccaaggtacgaaggtggagattaaa

SEQ ID NO: 884 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctccacgcccacacggtggtccgtatttagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtcttactctaccccgtggaccttcggtcaaggtaccaaggtggaaattaaa

SEQ ID NO: 885 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttcttctggttcttaccgcccatttgattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactatgactggccaccaacctttggccaaggtacgaaggtggagattaaa

SEQ ID NO: 886 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttcttctggttcttaccgcccatttgattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactattctacgccaccgtataccttcggtcaaggtaccaaggtggaaattaaa

SEQ ID NO: 887 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttcttacgtttaccgcatcggtacctggagctacgacgtgtacctgggcgatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggtgtgggattcttcttcttctgatcaaaattatgtgttcggtcaaggcacgaaggtggagattaaa

SEQ ID NO: 888 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgctacccatactctatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctctgcgctctggtttttttggccaaggtacgaaggtggagattaaa

SEQ ID NO: 889 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgtcttctggttctacggccgcgccgatcggttattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgaggcgtgggacgacaacctgagccgtcgcgttttcggtcagggtaccaaagtggagatcaaa

SEQ ID NO: 890 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcccgcggtggttacaagaccgcggacttatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcctgcaaggcgacggtttaccgcgtaccttcggtcaaggtaccaaggtggaaattaaa

SEQ ID NO: 891 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttgcctcttcttctgccggtggcgtggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataacaactggccagcgctgaccttcggtcaaggtaccaaggtggaaattaaa

SEQ ID NO: 892 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttggttacggtgactacggtggcattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcagctcttatacgtcttctgcgctggaattcggtcaaggtaccaaggtggaaattaaa

SEQ ID NO: 893 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttaactaccgctacttagccggctttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaaccaactctttcccgccgaccttcggtcaaggtaccaaggtggaaattaaa

SEQ ID NO: 894 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttccacgcgacttagactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagcatcagccactgggttttcggccagggcacgaaggttgagattaaa

SEQ ID NO: 895 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttccacgcgacttagactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatcactgggttttcggccagggcacgaaggttgagattaaa

SEQ ID NO: 896 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttccacgcggtggtgacaagtttgatccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtggcacagcggtgacaaccgttgggtgtttggtcaaggtacgaaagttgaaattaaa

SEQ ID NO: 897 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttcgcggtggttggtctgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacaggcctatagcccaccgatcacgttcggccagggcacgaaggttgagattaaa

SEQ ID NO: 898 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgtttctcacggttaccgctctatggataattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaatggttggccaccatggacctttggccaaggtacgaaggtggagattaaa

SEQ ID NO: 899 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttaccgccgccgcggtgacttaacccgtcgctacccgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaaacgagcggcaccggtatcccagtttttggtcagggcaccaaggttgagattaaa

SEQ ID NO: 900 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataactctacgccgctgaccttcggtcaaggtaccaaggtggaaattaaa

SEQ ID NO: 901 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgacggtgccaagtactacttaagctattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctacgctggtggtgttcggtcaaggtaccaaggtggaaattaaa

SEQ ID NO: 902 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcggtggtttatacaagtctggtcagtttgactcttggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatattactctatcccgcgtaccttcggtcaaggtaccaaggtggaaattaaa

SEQ ID NO: 903 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagccacgactcttctggttactacgattggattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttctacgtataccgtgttcggtcaaggtaccaaggtggaaattaaa

SEQ ID NO: 904 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagccacgactcttctggttactacgattggattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagatctgggattcttcttcttatgtggtgttcggtcaaggtaccaaggtggaaattaaa

SEQ ID NO: 905 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcaagacgccagagtgggagggtgccccgtttcaatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggactattctcgcaacaattgggtgtttggtcaaggtacgaaagttgaaattaaa

SEQ ID NO: 906 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagccaatactcttctggttggccaccagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaagcgattccacatttacgcttaacctttggccaaggtacgaaggtggagattaaa

SEQ ID NO: 907 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagccgcggtcgcggtcaacaagttggcaaaaactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggactattctcgcaacaattgggtgtttggtcaaggtacgaaagttgaaattaaa

SEQ ID NO: 908 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagctggcgcaagggttactactacggtcgtgatggttacccggacaattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttggcacagcggcgataaccgctgggttttcggccaaggcaccaaagttgagatcaaa

SEQ ID NO: 909 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccgagcaaccaaacggtggttggccactggattcttggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctaccctggcgttcggtcaaggtaccaaggtggaaattaaa

SEQ ID NO: 910 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactctggtagcgatcattgggttttcggtcaaggcacgaaagtggaaatcaaa

SEQ ID NO: 911 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggactcttacaatgatcatgttgttttcggtcagggtaccaaagtggagatcaaa

SEQ ID NO: 912 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgctctagctacgcctctagcggcacctgggttttcggtcaaggcacgaaagtggaaatcaaa

SEQ ID NO: 913 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcctattctggtgtttacgagcgcttctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagacgcagacgttcccaccgacctttggtcaaggtacgaaagttgaaattaaa

SEQ ID NO: 914 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtggtaaaggtggtttctggcacccatcttactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagccgttctgatcactgggttttcggccagggcacgaaggttgagattaaa

SEQ ID NO: 915 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtggtcgtgccgactacccattcgacatctggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagcggtgatgactgggttttcggccagggcacgaaggttgagattaaa

SEQ ID NO: 916 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctcgtgagcgcccagttggttcttactatagcggtttaggctacccgaaagattcttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcgtgtgtgggattcttctaacgaccattgggtttttggccagggtacgaaggtggagatcaaa

SEQ ID NO: 917 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctcgtaagtactaccacccaaactacggctattcttctgataactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcaggtttgggactacagccgtaataactgggttttcggtcagggtaccaaagtggagatcaaa

SEQ ID NO: 918 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtgaccactggtactctttagacgcctggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacaggaggatagcccaccgatcacgttcggccagggcacgaaggttgagattaaa

SEQ ID NO: 919 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtgagaacgcctacgtttctttcgatgcggttgactttggtatggatcattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaaagctatagcccaccaatcacgtttggtcagggcaccaaggttgagattaaa

SEQ ID NO: 920 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtggtggtgcccgctacgccttaaatagctggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtattacagcccaccaatcacctttggccaaggtacgaaggtggagattaaa

SEQ ID NO: 921 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtggtggtgccacggactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtcagcaatatggtagcagcccaaaaacgttcggtcagggcaccaaggttgagatcaaa

SEQ ID NO: 922 - DNA, 786 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtcacgtttcttggtacggtgactctgcgatttactactattactatggccagccatacggtatggattattggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtcaagcctgggacagcaacccgatggtggtgttcggtcaaggcacgaaggtggagattaaa

SEQ ID NO: 923 - DNA, 786 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtcacgtttcttggtacggtgactctgcgatttactactattactatggccagccatacggtatggattattggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtcaaggttgggacagctctgcgcatgtggttttcggtcagggtacgaaagttgaaattaaa

SEQ ID NO: 924 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtcaatgggaggcccaagccccattcgatttttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctggaattctagcttatctgccggcgtgtttggtcaaggtacgaaagttgaaattaaa

SEQ ID NO: 925 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaaaaaggttgccggttcttacccatatgatatctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacggaccatgtgctgttcggtcaaggtaccaaggtggaaattaaa

SEQ ID NO: 926 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttaataacaacacgggttgggccttcgacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctccgccaccaacgtttggccagggtacgaaggttgaaatcaaa

SEQ ID NO: 927 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcgccagctgggatgacagcttaaacggtcgtgtgtttggtcaaggtacgaaagttgaaattaaa

SEQ ID NO: 928 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcttatctcgcggctgggtgtttggtcaaggtacgaaagttgaaattaaa

SEQ ID NO: 929 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcttacagtattacaccccagcccgcgtgtttggccaaggtacgaaggtggagattaaa

SEQ ID NO: 930 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaaggcgcgcactggccgtgggccttcggtcagggcaccaaggttgagatcaaa

SEQ ID NO: 931 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggcgaacagcttcccacgcacctttggccaaggtacgaaggtggagattaaa

SEQ ID NO: 932 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagctacagcacgccatggacgtttggccagggtacgaaggttgaaatcaaa

SEQ ID NO: 933 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatggtcgttctatgtggacgttcggccagggcacgaaggttgagattaaa

SEQ ID NO: 934 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataacaattacccatggacgtttggccagggtacgaaggttgaaatcaaa

SEQ ID NO: 935 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtattacagcacgccacaatggacctttggccaaggtacgaaggtggagattaaa

SEQ ID NO: 936 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtattacagcacgccaacgtttggccagggtacgaaggttgaaatcaaa

SEQ ID NO: 937 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccactgggtgtttggccaaggtacgaaggtggagattaaa

SEQ ID NO: 938 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatgccacctctcgcccaaaatttggccaaggtacgaaggtggagattaaa

SEQ ID NO: 939 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctacgccgtatgtgttcggtcaaggtaccaaggtggaaattaaa

SEQ ID NO: 940 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgactctacgtactacggtttagatatttggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgaccgccgccacgctggtgtttggtcaaggtacgaaagttgaaattaaa

SEQ ID NO: 941 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgactctgttggttaccgcgaccagccgggttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagccgtacgggtgttttcggccaaggcaccaaagttgagatcaaa

SEQ ID NO: 942 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgagggtttctctggtacgtggacggcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaagctactctccaccgccgaccttcggtcaaggtaccaaggtggaaattaaa

SEQ ID NO: 943 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcactctacggttccagactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtacgatagcccaccgttaacgttcggccagggcacgaaggttgagattaaa

SEQ ID NO: 944 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagctctacggacgtggtgtttggtcaaggtacgaaagttgaaattaaa

SEQ ID NO: 945 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgtgccaattggccattaacgtttggccagggtacgaaggttgaaatcaaa

SEQ ID NO: 946 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacaggtgggtagcacgccatacacctttggccaaggtacgaaggtggagattaaa

SEQ ID NO: 947 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaaagctatgacagctctttattaagcccgctggttgttttcggtcagggtaccaaagtggagatcaaa

SEQ ID NO: 948 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgagctcttctaacgcggtgtttggtcaaggtacgaaagttgaaattaaa

SEQ ID NO: 949 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaccaatctagccgttttccaatcacgttcggccaaggcaccaaagttgagatcaaa

SEQ ID NO: 950 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatactatagcaccccaccaatgtactcttttggtcagggcaccaaggttgagattaaa

SEQ ID NO: 951 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagttttagatagcagcgacgaccacccagtggtttttggccagggtacgaaggtggagatcaaa

SEQ ID NO: 952 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcgagctgggacgattctttatctggctgggtgtttggtcaaggtacgaaagttgaaattaaa

SEQ ID NO: 953 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtggttacggtcactctggttatgcgttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcgccgtgtgggacgactctctgagcggctacgttttcggtcagggtaccaaagtggagatcaaa

SEQ ID NO: 954 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttaatcgaccgctacacgcgtaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaagcgaactctttcccggtgaccttcggtcaaggtaccaaggtggaaattaaa

SEQ ID NO: 955 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctgacgagtaccgcgccgttggcccgtacgactattggtcttatgcggcgttcgactactggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagtcttggggtgacgcctattacgtgtttggccaaggtacgaaagttgagattaaa

SEQ ID NO: 956 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagttttatctggtacgcgcgccaccctggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattctacgttacatggcgtgttcggtcaaggtaccaaggtggaaattaaa

SEQ ID NO: 957 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcagcgcggacgccggtgacaataacctgctgtttggtcaaggtaccaaggttgaaatcaaa

SEQ ID NO: 958 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaggttaccgcaacgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaagaagattctcgtccacgcacgtttggccagggtacgaaggttgaaatcaaa

SEQ ID NO: 959 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacttctctacgccgtcttttggccagggtacgaaggtggagatcaaa

SEQ ID NO: 960 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacacggacggttaccgctctagcttttactctaccgcctattggatggatccgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgttctagctatacctcttcttctacgctggtttttggccagggtacgaaggtggagatcaaa

SEQ ID NO: 961 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttccgcatgtcttctgacgtttactataatccagcctatatggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacacccataatacgacgtgggttttcggccaaggcaccaaagttgagatcaaa

SEQ ID NO: 962 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcactaccgccgcacgggtgaaggcatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataacaactggacgccgccgtatacgttcggtcaaggcacgaaagtggaaatcaaa

SEQ ID NO: 963 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaatcttatgatagctcttcttctcacgtggtttttggccagggtacgaaggtggagatcaaa

SEQ ID NO: 964 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcagctcttatacgtcttctaccacccaggttttcggtcaaggcacgaaagtggaaatcaaa

SEQ ID NO: 965 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcacctctgaggttttcggccaaggcaccaaagttgagatcaaa

SEQ ID NO: 966 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctaaaggtcactctacgatgcaatacttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctttgccgattctcgctacatttttggccaaggtacgaaggtggagattaaa

SEQ ID NO: 967 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtgccgcgtgggacgattctagcggccgctgggtgttcggtcaaggcaccaaagttgagatcaaa

SEQ ID NO: 968 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaacagtactattctaccaccccatatacgttcggtcagggcaccaaggttgagatcaaa

SEQ ID NO: 969 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccgatttacaatacgactactggggtcaatggggccagggtacgctggttaccgtgagctctggtggtagcagccgtagctcttcttctggtggtggcggttctggcggcggcggtgaaattgttctgacccagtctccggcgacgctgagcctgagcccgggcgaacgtgccacgctgtcttgtcgtgcgagccaaagcgtttcttctagctacttagcctggtatcaacagaagccgggtcaggcgccacgcctgttaatttacggtgcgagcagccgcgcgacgggtatcccggcccgcttctctggcagcggctctggcaccgatttcaccctgaccatctctcgtctggaaccagaggattttgccgtttactattgtcaagtgtgggacagctctgatggcgttgtgttcggtcaaggcaccaaagttgagatcaaa

SEQ ID NO: 970 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccatcgcttatggacgacgggttggggtcgcgatgcgttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaacctggacgacgggtcattgggtgtttggtcaaggtacgaaagttgaaattaaa

SEQ ID NO: 971 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccatcgacgccttagccgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttcttctcatcatctggttgttttcggtcagggtaccaaagtggagatcaaa

SEQ ID NO: 972 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagccatcgacgccttagccgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttcttctctgagcgtggttttcggtcaaggcacgaaagtggaaatcaaa

SEQ ID NO: 973 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttccgcggtggtggttcttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacggctcttcttctccgcgttggaccttcggtcaaggtaccaaggtggaaattaaa

SEQ ID NO: 974 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttccgcggtggtggttcttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctttaagcggctgggtgttcggtcaaggtaccaaggtggaaattaaa

SEQ ID NO: 975 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtatgcagggcaagcagtggccaaaggcctttggccagggtacgaaggttgaaatcaaa

SEQ ID NO: 976 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctacgacggtggtgtttggtcaaggtacgaaagttgaaattaaa

SEQ ID NO: 977 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtggtggtgtttacacgctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctattcgtcgtgttttcggtcaaggcacgaaagtggaaatcaaa

SEQ ID NO: 978 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaacgtggcaattggccacgcttattcagcttcggccagggcacgaaggttgaaatcaaa

SEQ ID NO: 979 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagctctggtcaccgcgtggtttttggccagggtacgaaggtggagatcaaa

SEQ ID NO: 980 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacggtcactggtaccgcggttactatggctcttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcagctctaacgttgtttttggtcagggcaccaaggttgagattaaa

SEQ ID NO: 981 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctagcatgggtacgtgggtttttggccagggtacgaaggttgaaatcaaa

SEQ ID NO: 982 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccacacgatgttaggttctttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcaagcatcataacagcgaccgctggacgtttggccagggtacgaaggttgaaatcaaa

SEQ ID NO: 983 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacatctcttcttggtacaagtctggcgcgttcggttattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtaccacaaccgtccgctgtggacgttcggtcaaggcacgaaagtggaaatcaaa

SEQ ID NO: 984 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacatctcttcttggtacaagtctggcgcgttcggttattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaaagcgccgcctctagcggcagcgttgttttcggtcagggtaccaaagtggagatcaaa

SEQ ID NO: 985 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaggtttcacgcgcggttttgatccatggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttcttctgattgggtgtttggtcaaggtacgaaagttgaaattaaa

SEQ ID NO: 986 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaggttggtaccgcggttacggccatgccggtgcggttgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtgccgcctgggatgatagcttatcttctggtggcgtttttggccagggtacgaaggtggagatcaaa

SEQ ID NO: 987 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcgccgaatgggcggacagcttatctggtggcgtgtttggtcaaggtacgaaagttgaaattaaa

SEQ ID NO: 988 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagctgcgcggctacccattaacctttggccaaggtacgaaggtggagattaaa

SEQ ID NO: 989 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagagcgacagcacgttatcttggagctttggccaaggtacgaaggtggagattaaa

SEQ ID NO: 990 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaatctacacggcccaagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctcagggcgccaattggccatgggttttcggccagggcacgaaggttgagattaaa

SEQ ID NO: 991 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttacgcttctctggtgtttttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctggtccgggctgggtgttcggtcaaggtaccaaggtggaaattaaa

SEQ ID NO: 992 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgcgaccggtgatgactctcgcaatggcgtggttttcggtcaaggcacgaaagtggaaatcaaa

SEQ ID NO: 993 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtgaagcgtgggacgattcttctatcggctgggtgtttggtcaaggtacgaaagttgaaattaaa

SEQ ID NO: 994 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtatgcagagcatccagccaggttggacgtttggccagggtacgaaggttgaaatcaaa

SEQ ID NO: 995 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtgggacagctctccagacgatgtgtttggtcaaggtacgaaagttgaaattaaa

SEQ ID NO: 996 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggcgtacgattctggtaacattgtgtttggtcaaggtacgaaagttgaaattaaa

SEQ ID NO: 997 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggaatgggacagctctatcggtgtgtttggccaaggtacgaaggtggagattaaa

SEQ ID NO: 998 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagccgtacgattcttcttctagcggcccgtacgttttcggtcagggtaccaaagtggagatcaaa

SEQ ID NO: 999 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtcttatacgccaacgtatacctttggtcaaggtacgaaagttgaaattaaa

SEQ ID NO: 1000 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtacaataactggccaccatatacctttggtcaaggtacgaaagttgaaattaaa

SEQ ID NO: 1001 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgataacacgttacgtggcagcatcttcggtcaaggcacgaaagtggaaatcaaa

SEQ ID NO: 1002 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgattcttctttaagcgcgtatgttttcggtcaaggcacgaaagtggaaatcaaa

SEQ ID NO: 1003 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagagctacgatacgtctcgcggcattaaagttttcggtcaaggcacgaaagtggaaatcaaa

SEQ ID NO: 1004 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctgggacagctctacgggtgtgtttggccaaggtacgaaggtggagattaaa

SEQ ID NO: 1005 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctgaccatccgagctgggttttcggtcaaggcacgaaagtggaaatcaaa

SEQ ID NO: 1006 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgttcgcccgcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctaccgaaggcgttttcggtcaaggcacgaaagtggaaatcaaa

SEQ ID NO: 1007 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttaacgcaattatacttcgcgtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagacgtggggcacgggtacgtggggctgggtgtttggtcaaggtacgaaagttgaaattaaa

SEQ ID NO: 1008 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacttagttacgggttctttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccaccaccagcgtttaccttcggtcaaggtaccaaggtggaaattaaa

SEQ ID NO: 1009 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccaagagggttaccgcgcctatggctacaacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaagccaatagcaccccattaacgttcggccaaggcaccaaagttgagatcaaa

SEQ ID NO: 1010 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccaagagggttaccgcgcctatggctacaacggcatggacgtgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaatcttacgatgcgaataacgttgttttcggccaaggcaccaaagttgagatcaaa

SEQ ID NO: 1011 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccaatctggtacgatcgccctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctccggtggtgttcggtcaaggtaccaaggtggaaattaaa

SEQ ID NO: 1012 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagaccgccgcggtgccggttactattatttcgaccattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactacggtagcccgctgacgttcggtcaaggcacgaaagtggaaatcaaa

SEQ ID NO: 1013 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactctgccgccgccgccgccgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgaatacgaacacgctggtggtgttcggtcaaggtaccaaggtggaaattaaa

SEQ ID NO: 1014 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagacacgtctcgctactctttagcgtttggtttcggcgacttttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcagctctccatacgttgtgttcggccagggcacgaaggttgaaatcaaa

SEQ ID NO: 1015 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgccgcctgggacgatagcctgaacggtcactacgtgttcggccagggcacgaaggttgaaatcaaa

SEQ ID NO: 1016 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgccgagtgggccgatagcctgtctggtggtgtttttggtcagggcaccaaggttgagattaaa

SEQ ID NO: 1017 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgaggcctgggacgatagcctgtctggttacgttgtgttcggccagggcacgaaggttgaaatcaaa

SEQ ID NO: 1018 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgagtcttacgatagcagccgcaacgttgtttttggtcagggcaccaaggttgagattaaa

SEQ ID NO: 1019 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagcctgggacagcaatccggccgttgttttcggccaaggcaccaaagttgagatcaaa

SEQ ID NO: 1020 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatacaataatccgttattcacgttcggccaaggcaccaaagttgagatcaaa

SEQ ID NO: 1021 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatacaatagcagcttatggacgttcggtcagggtaccaaagtggagatcaaa

SEQ ID NO: 1022 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtgggacagctttggccaagttttcggtcagggtaccaaagtggagatcaaa

SEQ ID NO: 1023 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacgcgagcaatacgcacgttaagtttggtcagggcaccaaggttgagattaaa

SEQ ID NO: 1024 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagactggggttggtaccgcggttacggtcatgcgggtgccgtggacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcagctctacgcacgttgtgttcggccagggcacgaaggttgaaatcaaa

SEQ ID NO: 1025 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcgcagcaactggtggccagccattacctttggtcaaggtacgaaagttgaaattaaa

SEQ ID NO: 1026 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaagagacgacgggtatcggtgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagctcttctcaccattgggtgtttggtcaaggtacgaaagttgaaattaaa

SEQ ID NO: 1027 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttcttatcttctgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacattatcacaattctgttccagtgacctttggtcaaggtacgaaagttgaaattaaa

SEQ ID NO: 1028 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttcttatcttctgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttctaattggccaccagcctttaattttggtcaaggtacgaaagttgaaattaaa

SEQ ID NO: 1029 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtttcttatcttctgccttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatggtagcccatctggtctgacctttggtcaaggtacgaaagttgaaattaaa

SEQ ID NO: 1030 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtggttgggcctacatcttcgactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggatagctctagcggtgacggtgcgggcgtgttcggtcaaggtaccaaggtggaaattaaa

SEQ ID NO: 1031 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggtcactcttctacgtacgttattgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtggcacctgggacagctctttatctagcgcggcggttttcggtcaaggcacgaaagtggaaatcaaa

SEQ ID NO: 1032 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttctccatctggtttatacagcctggacttctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatataacaacggtccgattaccttcggtcaaggtaccaaggtggaaattaaa

SEQ ID NO: 1033 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaggttacggtccagccaacgcctttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctcttcttctagccatctggttttcggtcaaggcacgaaagtggaaatcaaa

SEQ ID NO: 1034 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaaatggactcttactacgcctacggtctggatttctggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtagcagctacacctctacgaacaccctggtgttcggtcaaggtaccaaggtggaaattaaa

SEQ ID NO: 1035 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacaaaacgccatctctttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtatgcagggtacccattggcacctggccttcggtcagggcaccaaggttgagatcaaa

SEQ ID NO: 1036 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacaaaacgccatctctttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtaccacgtgggatagcttaaatggtgaggtttttggccagggtacgaaggttgaaatcaaa

SEQ ID NO: 1037 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgcgccaacggtcacacgacgtttgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagacctggggtaccggtatccgcgtgtttggccaaggtacgaaggtggagattaaa

SEQ ID NO: 1038 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgccacgacgccttatgggccttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcggtacctgggattctcgtatgggtgcctgggtttttggccagggtacgaaggttgaaatcaaa

SEQ ID NO: 1039 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaacgcccaccaatctcttggggtccagcgtttgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttctttaaataatctgtgggttttcggtcaaggcacgaaagtggaaatcaaa

SEQ ID NO: 1040 - DNA, 783 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctgacgagtaccgcgccgttggcccgtacgactattggtcttatgcggcgttcgactactggggccagtggggccagggtacgttagttacggtgtcttctggcggcagctctcgtagctctagcagcggcggtggcggctctggcggcggcggcgaaattgtgctgacgcaaagcccagccaccctgagcttaagcccaggtgagcgtgccacgttaagctgtcgtgccagccaaagcgtgtcttctagctacctggcctggtaccagcagaaaccaggccaagccccacgtttattaatctacggcgcgagctctcgtgcgaccggtattccggcgcgcttcagcggcagcggttctggcaccgacttcacgctgacgatcagccgcctggagccggaagactttgccgtttactattgccagtcttacgactctagcttaagcggcagctacgttttcggccaaggtaccaaggtggaaattaaa

SEQ ID NO: 1041 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctatcggttggatcggtttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaatatagctctagcttagttgcctttggccagggtacgaaggttgaaatcaaa

SEQ ID NO: 1042 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatctttatggggtggtttcgactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggagagcagcaaccatttagttgtttttggccagggtacgaaggttgaaatcaaa

SEQ ID NO: 1043 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaaatacgtttactacggttcttacctgcgttacgccatggatccatggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtgcggcctctgacgatagcctgaactcttgggttttcggccaaggcaccaaagttgagatcaaa

SEQ ID NO: 1044 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgccggtggttctggttctttctatcgtttattcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatcttacggcattccgttaacgttcggtcagggtaccaaagtggagatcaaa

SEQ ID NO: 1045 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcctctgccgacgactactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtagctcttatacgagcagctctctgcgcgttttcggccagggcacgaaggttgagattaaa

SEQ ID NO: 1046 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgcctacacgggtcgctctggtctggattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactattctacgccatttccgtttggtcaaggtacgaaagttgaaattaaa

SEQ ID NO: 1047 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgcccgctacgttccagacgatggctggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagctctgaccacgtggtgtttggtcaaggtacgaaagttgaaattaaa

SEQ ID NO: 1048 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtgcctgggagaccagcctgtctggtggtgtttttggtcagggcaccaaggttgagattaaa

SEQ ID NO: 1049 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacgactcttaccgcggtccactgcatggttactttgactattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcagcgaccacggtgtttttggtcagggcaccaaggttgagattaaa

SEQ ID NO: 1050 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggtttaggttaccgcaacctgtttggttctcatgttagccgttggtttgacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagagctacgactcttctctgtctgatgtggtgttcggtcaaggcacgaaggtggagattaaa

SEQ ID NO: 1051 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggcgtgggactctcgctctctggttgtgtttggccaaggtacgaaagttgagattaaa

SEQ ID NO: 1052 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcaggccaagtctttcccgttaacctttggccaaggtacgaaagttgagattaaa

SEQ ID NO: 1053 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtactgtgcctctccgcaaacctttggccaaggtacgaaagttgagattaaa

SEQ ID NO: 1054 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtacggttcttggccactggccgtgacctttggtcaaggtaccaaggttgaaatcaaa

SEQ ID NO: 1055 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacggttacttctaccgccgcaatgtgacgacgtattacagcagctatatggactactggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggactcttctacggatttagtggtgtttggtcaaggtaccaaggttgaaatcaaa

SEQ ID NO: 1056 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccaccgcttagttccagttgcggcgcaattatattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtcttactctccgccgattacgttcggtcaaggcacgaaagtggaaatcaaa

SEQ ID NO: 1057 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacactactacgttgccatggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaaggcacccacccgccaccaacgtttggccagggtacgaaggttgaaatcaaa

SEQ ID NO: 1058 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctctttatctgccggcgtttttggccagggtacgaaggtggagatcaaa

SEQ ID NO: 1059 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggtcacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggcctgggatagcacgagcccatgggttttcggccagggcacgaaggttgagattaaa

SEQ ID NO: 1060 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccatctggttctttagactattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttggcagggcacgaattctttagttgtgtttggccaaggtacgaaggtggagattaaa

SEQ ID NO: 1061 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgacccaacgggttaccgcttaagcagcttatactattacgcgggctttgcctacggtatggatgtgtggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtgagacgtgggacagcaacacccaggtgttcggtcaaggcacgaaggtggagattaaa

SEQ ID NO: 1062 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccaaacgtactacgactctagcctgtcttacggctacgcgtttgatatctggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtgaaacctgggattctaacacgcgcgtgttcggccagggcacgaaggttgaaatcaaa

SEQ ID NO: 1063 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtacgtgggacagcagcctgtcttctggtgtttttggtcagggcaccaaggttgagattaaa

SEQ ID NO: 1064 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcggttaccgcggttactatgcgggtaactggtttgacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcggtgtttgggacagcagcagcgaccactctgttgtgttcggccagggcacgaaggttgaaatcaaa

SEQ ID NO: 1065 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagcgctattctccaaactttacctttggtcaaggtacgaaagttgaaattaaa

SEQ ID NO: 1066 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcatcgttccagccggtagcgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcagcagtactatcgcgcctctcagagctttggtcaaggtacgaaagttgaaattaaa

SEQ ID NO: 1067 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcaaggacttccgcatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtggcacgtgggataattctctgaacacgggtggcgtgtttggtcaaggtacgaaagttgaaattaaa

SEQ ID NO: 1068 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgcaagtctacgccaccagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatgacagctcttctggtaataaagtgttcggtcaaggtaccaaggtggaaattaaa

SEQ ID NO: 1069 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgtgggattctagcgacgttgtttttggccagggtacgaaggttgaaatcaaa

SEQ ID NO: 1070 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgaccgccgcgacttaacgttagattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagtgtgggattctagccacgacggtgtggtgtttggtcaaggtacgaaagttgaaattaaa

SEQ ID NO: 1071 - DNA, 792 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgctctccggtgtactacgattactattatcgtgagtctgaccgttatggcatggatgtttggggtcaatggggtcaaggcacgttagtgaccgtgtctagcggcggtagcagccgttctagcagctctggcggcggcggcagcggcggcggcggtgagattgttttaacccagagcccagcgacgttatctctgtctccaggtgaacgcgcgacgctgtcttgccgtgcctctcagtctgtgtcttctagctatctggcctggtatcaacaaaagccgggtcaagccccacgtctgctgatctatggcgcgtctagccgtgcgacgggtattccggcgcgcttcagcggctctggttctggcacggactttacgctgacgattagccgcctggagccagaggattttgcggtttactactgtcagcaagcgctgagctcttctccatggaccttcggtcagggtaccaaagtggagatcaaa

SEQ ID NO: 1072 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgcgaagcgtggcacgactctggtagcggttttgtgtttggtcaaggtaccaaggttgaaatcaaa

SEQ ID NO: 1073 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccagcagtcttactctacgccgcgcccgacctttggtcaaggtaccaaggttgaaatcaaa

SEQ ID NO: 1074 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggaccgctcttctagccacgtggtgtttggtcaaggtaccaaggttgaaatcaaa

SEQ ID NO: 1075 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctggtggttaccgcacgagcggcccatactttcaaggctatgcgatggacgtttggggtcagtggggccagggcacgttagttacggttagctctggtggcagcagccgcagcagctctagcggcggcggtggcagcggtggcggcggcgaaattgtgctgacccaatctccggccacgctgagcctgtctccgggtgagcgcgcgacgttatcttgccgcgcgtctcagtctgtgagctcttcttatttagcgtggtaccaacagaaaccgggtcaggccccacgcctgttaatctacggtgcgagcagccgcgcgaccggcatcccggcgcgtttctctggcagcggctctggtaccgatttcacgttaaccatctctcgtttagaaccagaagatttcgcggtttactactgccaggtgtgggactcttcttctgatcacccggtgtttggtcaaggtaccaaggttgaaatcaaa

SEQ ID NO: 1076 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgactctacgatctactctacggatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgctctagctatacgaatacgaacacgctggtggtgttcggtcaaggtaccaaggtggaaattaaa

SEQ ID NO: 1077 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagccataccgcgttcgcttatttcgttacatggactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactcttctgatcattatgttttcggtcaaggcacgaaagtggaaatcaaa

SEQ ID NO: 1078 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgagcaatactactcttcttctggcgcgttagcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcagcacggttgttttcggccaaggcaccaaagttgagatcaaa

SEQ ID NO: 1079 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgcctaccgccgcgttccaaaaatgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatggttcttctccgattaccttcggtcaaggtaccaaggtggaaattaaa

SEQ ID NO: 1080 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtgactaccgcgttacgggtagcaccacgtactttgaccattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatactatagcagcacgccacgcttaagcttcggccagggcacgaaggttgaaatcaaa

SEQ ID NO: 1081 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtggttcttggggttactggatggactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagcgcagcaatccaccgtctttcacgtttggccagggtacgaaggttgaaatcaaa

SEQ ID NO: 1082 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtaaggcctggggttggttcgacccatggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgcgagacctgggacagcaattcttgggtgttcggtcaaggcaccaaagttgagatcaaa

SEQ ID NO: 1083 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtggtacctgggatagctctttatctgactgggtgttcggccagggcacgaaggttgaaatcaaa

SEQ ID NO: 1084 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgcggttaccgcggtggcggcacgtacgatgcctttgatgtgtggggtcaatggggtcagggcaccctggttacggtttcttctggcggttctagccgtagctctagcagcggtggcggcggctctggcggcggtggcgaaattgtgctgacccagagcccagccaccttatctctgagcccgggtgaacgcgccacgctgtcttgtcgcgcgtctcagtctgtgtctagcagctacttagcgtggtaccagcaaaagccgggccaggccccgcgcttattaatttacggtgcctctagccgtgcgacgggcattccggcccgttttagcggttctggcagcggcacggactttaccttaacgatcagccgcttagaaccagaagactttgcggtttattactgtcaagtgtgggatagctcttctgaccacctgtacgtgtttggccaaggtacgaaagttgagattaaa

SEQ ID NO: 1085 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttacgctggggtgccttcgacatttggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagcaaagctattctccgccaatctcttttggccagggtacgaaggttgaaatcaaa

SEQ ID NO: 1086 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttataccgcggtttcggtgtgggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcatgcaaggcgccaacggtccgccggtgttcggtcaaggtaccaaggtggaaattaaa

SEQ ID NO: 1087 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtttataccgcggtttcggtgtgggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactactctaccaccgcgttaacgttcggtcagggtaccaaagtggagatcaaa

SEQ ID NO: 1088 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtccagaggacatgttatctttcgatgtgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaagcgctggacagctctacgggtgtggtgtttggtcaaggtacgaaagttgaaattaaa

SEQ ID NO: 1089 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgcgactctggttctttcattattgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggattcttactctacccatgtgttcggtcaaggtaccaaggtggaaattaaa

SEQ ID NO: 1090 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgccaaggtttcgcctctggcggcgttgacctgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgtgggaccgcaacagcgatcgtgttttcggtcaaggcacgaaagtggaaatcaaa

SEQ ID NO: 1091 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtcgctaccgcggtttcggtgtgggcttcgacatttggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagcgtgggactctaacagcgcggtggttttcggtcaaggcacgaaagtggaaatcaaa

SEQ ID NO: 1092 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttaccgcacgtcttctagcaaacaatacctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaatcttacgatagcaatttatctggtccagtgttcggccagggcacgaaggttgaaatcaaa

SEQ ID NO: 1093 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggttcttaccgcacgtcttctagcaaacaatacctggacccgtggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaaacgtacgataatggcttacgcggttctattttcggccagggcacgaaggttgaaatcaaa

SEQ ID NO: 1094 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtaactcttatgcgggctctggttacgtttttggtcagggcaccaaggttgagattaaa

SEQ ID NO: 1095 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagcacgggttacgtttttggtcagggcaccaaggttgagattaaa

SEQ ID NO: 1096 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatatcataatacgccaacgttcggccaaggcaccaaagttgagatcaaa

SEQ ID NO: 1097 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatataatagcttcccaccaacgtttggtcagggcaccaaggttgagattaaa

SEQ ID NO: 1098 - DNA, 768 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtggtacgaactcttaccgccgcctggtgtacgacgcgttcgatatttggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagtttgggatagcggctctacgcgcttaggcgtttttggccagggtacgaaggtggagatcaaa

SEQ ID NO: 1099 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccacccatctgccgccggtgcgtttgacatctggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaaaattactctacgccgtggacctttggtcaaggtacgaaagttgaaattaaa

SEQ ID NO: 1100 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcacccattataccgcaacgccgcggatgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggtttgggattactctcgcaataattgggtgttcggtcaaggtaccaaggtggaaattaaa

SEQ ID NO: 1101 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggtccagccgccggtcgttttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgaaacgtgggatggttctttaagcaccgtggttttcggtcaaggcacgaaagtggaaatcaaa

SEQ ID NO: 1102 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggtccagccgccggtcgttttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggcctgggatggttcttctgtggtgtttggtcaaggtacgaaagttgaaattaaa

SEQ ID NO: 1103 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaccgcggtccagccgccggtcgttttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaatatggttcttctacctataccttcggtcaaggtaccaaggtggaaattaaa

SEQ ID NO: 1104 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtatcccaaaccgctctcacggtggctggtttgacccatggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcggcacgtgggattcttctttaagcgcgaatgttttcggtcaaggcacgaaagtggaaatcaaa

SEQ ID NO: 1105 - DNA, 777 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaaggagtaccgcacgttcgacagcccgtacacgctgtaccgtagcagcgcctacttcgattattggggccagtggggtcaaggtacgttagtgacggttagcagcggcggtagcagccgcagcagcagctctggcggcggtggcagcggcggcggcggcgaaattgttttaacccaatctccggcgaccttaagcttatctccaggcgagcgcgccaccttaagctgtcgtgccagccagtctgttagctctagctacttagcgtggtatcagcaaaaaccaggtcaagcgccacgcttattaatttatggcgccagcagccgtgccaccggcattccagcccgttttagcggttctggcagcggtacggactttacgttaaccatcagccgcctggaaccagaagacttcgccgtgtattattgtcaatctgccgattctagcggcccggttttcggtcagggtacgaaagttgaaattaaa

SEQ ID NO: 1106 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaagcgcccacgcccaccatactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagctctgatcaccaagtttttggccagggtacgaaggttgaaatcaaa

SEQ ID NO: 1107 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttaggtccacactacggtatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcagacgtggggcaccggtgatgttgttttcggccagggcacgaaggttgagattaaa

SEQ ID NO: 1108 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtttacacttacgcggttctatcggcctgccaccagattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcaatacaagcgtaatccgcgcacgttcggtcagggtaccaaagtggagatcaaa

SEQ ID NO: 1109 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtaacgccgttgccggtacgtggttaagcagcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaagtgttagactctagcagcgatgacgttgttttcggccaaggcaccaaagttgagatcaaa

SEQ ID NO: 1110 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcaatactcttctggttggccatggttcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtatggtagctctccattcacctttggccaaggtacgaaggtggagattaaa

SEQ ID NO: 1111 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgacccaggtacgtggcaattcgatccgtggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcatgcaagcgcgtcaaaccccagttacgtttggccagggtacgaaggttgaaatcaaa

SEQ ID NO: 1112 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcgactctggtaacatgtacggttattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtgcggcctgggatagccgcagccgcttatacatgtttggccagggtacgaaggttgaaatcaaa

SEQ ID NO: 1113 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatccgcgccaactctcgctatagcccagacccgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactctcgcctgagcaccggtatgttcggtcaaggcacgaaagtggaaatcaaa

SEQ ID NO: 1114 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcatccgcgccaactctcgctatagcccagacccgtggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtactacgacccgccgtggaccttcggtcaaggtaccaaggtggaaattaaa

SEQ ID NO: 1115 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgcttacgcggtcgcgccatggagaccgattactggggtcagtggggtcagggcaccttagttacggtgagcagcggcggttcttctcgctctagctcttctggcggcggcggtagcggcggtggcggcgaaatcgtgctgacgcagagcccggcgaccctgagcctgtctccaggcgagcgcgcgaccctgtcttgccgcgcctctcagtctgtttctagctcttatttagcgtggtaccagcagaagccaggccaagcgccacgcctgctgatttacggcgcctcttctcgtgccacgggtatcccggcgcgtttcagcggcagcggtagcggcaccgacttcaccctgaccatctctcgtctggagccagaggatttcgccgtgtactattgtcaggtgtgggacagccgccacgaccattgggtgtttggtcaaggtacgaaagttgaaattaaa

SEQ ID NO: 1116 - DNA, 771 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtcgctctggttctggttggttacactattataaggactattacatggatgtgtggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaacgtagcaattggccacgcatgatcacgtttggtcagggcaccaaggttgagattaaa

SEQ ID NO: 1117 - DNA, 780 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttctcgcgccggttaccgcgttgattatttagcctggagcggtctgtttgattactggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtagcacctatgacaactctcaacgtaacggcggcagcgttttcggtcagggtacgaaagttgaaattaaa

SEQ ID NO: 1118 - DNA, 774 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttcttacgtttaccgcatcggtacctggagctacgacgtgtacctgggcgatgtttggggtcaatggggccagggcaccttagttacggtttctagcggtggtagcagccgttctagcagctctggcggcggcggtagcggcggtggcggcgaaattgtgctgacccagtctccagcgacgttaagcctgagcccaggcgagcgcgccaccttatcttgtcgtgccagccaaagcgttagcagctcttacctggcctggtatcaacaaaaaccgggccaagcgccacgcttactgatctacggtgccagcagccgtgccaccggcattccagcgcgtttttctggtagcggcagcggtacggattttacgttaacgatttctcgcctggagccggaggattttgccgtgtactactgtcaggtgtgggattcttcttctgaccattacgtgtttggccaaggtacgaaagttgagattaaa

SEQ ID NO: 1119 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgatgcgcggtcaattaggttactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagcgcagcaattggccaggcccattcacgtttggccagggtacgaaggttgaaatcaaa

SEQ ID NO: 1120 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtacgcgctacccatactctatggacgtgtggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtagctcttatgattctagctctggtttcgtggtgtttggtcaaggtacgaaagttgaaattaaa

SEQ ID NO: 1121 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgttttatcttctcgctcttggggtagcggctacttcgattactggggccagtggggccaaggtacgctggtgaccgtgtcttctggtggttctagccgctctagcagcagcggtggcggcggtagcggcggcggtggcgaaatcgtgctgacccagagcccggcgaccttatctctgtctccaggcgaacgtgccaccttatcttgtcgtgcctctcaaagcgttagctctagctacctggcgtggtaccaacagaagccgggtcaagcgccgcgtttactgatctacggtgcgtcttctcgcgccaccggcattccagcgcgtttttctggcagcggctctggtaccgattttacgttaaccatttctcgcttagaaccagaggatttcgcggtttattattgtcagcacaagaacagctatccgttaatcttcggtcagggtaccaaagtggagatcaaa

SEQ ID NO: 1122 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgtgtttcttacggtggtttaggtagcctggacttctatttccagcattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaagcctgggatagcagcggtgttgttttcggccaaggcaccaaagttgagatcaaa

SEQ ID NO: 1123 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttacacgtggatcggtttcgacatctggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacattactataccgttccgttcacgttcggccagggcacgaaggttgagattaaa

SEQ ID NO: 1124 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgcgcggcccgtgacgacaacctggatggctgggttttcggtcaaggcacgaaagtggaaatcaaa

SEQ ID NO: 1125 - DNA, 747 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgcccgttactacgacccaacgggttacctgaccgactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccagcaacattactctacgccgcgtaccttcggtcaaggtaccaaggtggaaattaaa

SEQ ID NO: 1126 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgagggttaccgcacggaccgcaaatattggttagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcggtacctgggactctggtagcagcgcgggtatcttcggtcagggtaccaaagtggagatcaaa

SEQ ID NO: 1127 - DNA, 753 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccagcgagggttaccgcacggaccgcaaatattggttagactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcatgcaaggcgccccacgcccgtttaccttcggtcaaggtaccaaggtggaaattaaa

SEQ ID NO: 1128 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcgactcttctggctatatggactactggggccaatggggccagggcacgttagttaccgtgagcagcggtggttcttctcgcagctcttctagcggcggcggtggcagcggtggcggcggcgagattgtgttaacccagagcccggcgaccctgagcttatctccgggtgagcgtgcgaccttaagctgtcgcgccagccaatctgttagctctagctacctggcctggtatcagcaaaagccgggtcaggccccacgtctgctgatctatggtgcctctagccgcgccacgggtattccggcgcgctttagcggctctggcagcggcacggactttaccctgacgatcagccgtttagagccagaagacttcgcggtttattactgccaggtttgggattcttcttctgatcatgtggttttcggtcaaggcacgaaagtggaaatcaaa

SEQ ID NO: 1129 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcgccgcctgggacgatagcctgtctggtttctacgtgttcggccagggcacgaaggttgaaatcaaa

SEQ ID NO: 1130 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgcttattatcttatagcggcgcccgccacgtttttggtcagggcaccaaggttgagattaaa

SEQ ID NO: 1131 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaacaatacgaaaattatccattaacgttcggccaaggcaccaaagttgagatcaaa

SEQ ID NO: 1132 - DNA, 765 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcagctctcacttagttgtgttcggccagggcacgaaggttgaaatcaaa

SEQ ID NO: 1133 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggtggttaccgcggtgttttagcgggcgttgcctttgacatttggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgccaagtttgggacagcagcaccgccgttttcggtcagggtaccaaagtggagatcaaa

SEQ ID NO: 1134 - DNA, 756 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgcaacagccgcgactctcgtggcgaacacgttatcttcggccaaggcaccaaagttgagatcaaa

SEQ ID NO: 1135 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacgacgacctgccgattacgttcggtcaaggcacgaaagtggaaatcaaa

SEQ ID NO: 1136 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccggttcttaccgcaagtacgccggcggcttcgactattggggtcagtggggccagggtacgttagtgaccgtgagctctggtggttcttctcgttcttctagcagcggcggtggcggctctggcggcggcggtgaaattgttctgacccagagcccggcgaccctgtctttaagcccaggtgaacgtgcgacgctgtcttgtcgcgcgtctcaatctgtgtctagctcttatttagcgtggtatcaacaaaaaccaggccaagccccgcgtctgttaatttacggtgccagctctcgcgccacgggcattccggcccgttttagcggtagcggcagcggtacggattttaccttaacgattagccgcttagagccggaggactttgccgtgtactattgccaacagtacggttctagcccgaaaacgttcggtcaaggcacgaaagtggaaatcaaa

SEQ ID NO: 1137 - DNA, 732 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgccaccttaggtccaaacgaccactggggtcagtggggccaaggtaccttagtgaccgtgtcttctggtggcagcagccgttcttcttcttctggtggcggtggtagcggcggcggtggcgaaatcgtgctgacccaaagcccggccaccctgagcctgagcccgggcgaacgcgccaccttatcttgccgtgcgtctcagtctgtttctagctcttacttagcgtggtaccagcaaaaaccaggccaggccccacgtttactgatctacggcgcgagctctcgtgccacgggtattccagcccgcttcagcggcagcggtagcggcaccgactttaccctgacgatcagccgtctggagccagaagatttcgccgtttattactgtctgcaatataacagcaccccatggaccttcggtcaaggcaccaaagttgagatcaaa

SEQ ID NO: 1138 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgttctcgtaaggttggtgccttcggtaactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgcacgagctacaccagctctagcgagttatacgcgtttggccaaggtacgaaggtggagattaaa

SEQ ID NO: 1139 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtacgcgtgacttcatcggtcgcggtttcgattattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagcgttacagcgccccatacacctttggccaaggtacgaaggtggagattaaa

SEQ ID NO: 1140 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgccttctcttactcttggccattcgatcattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgccaacagtataagaattggcacccaacgtggagctttggccaaggtacgaaggtggagattaaa

SEQ ID NO: 1141 - DNA, 759 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtgactctgttggttaccgcgaccagccgggttactatttagattattggggccaatggggtcaaggcaccctggtgacggtttcttctggtggctcttctcgtagcagctctagcggcggtggcggcagcggtggcggcggtgaaattgtgctgacccagagcccggccacgctgtctttaagcccgggcgagcgtgccacgttaagctgtcgcgccagccaaagcgttagctctagctatttagcctggtatcaacagaagccaggccaggcgccacgtttattaatctatggtgcctcttctcgtgcgaccggtattccggcgcgctttagcggctctggtagcggcaccgacttcaccctgacgatctctcgtttagagccggaggatttcgcggtgtactattgtcaacaatataatagctacccatctacgtttggtcagggcaccaaggttgagattaaa

SEQ ID NO: 1142 - DNA, 744 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtaagaaccaaacggccggtggtcattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcaggtttgggatagccgcgcggaccactgggtttttggccagggtacgaaggttgaaatcaaa

SEQ ID NO: 1143 - DNA, 738 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcgcggtgccaagggtttaggttattggggccaatggggtcagggtaccctggtgacggtttctagcggcggcagctctcgctcttcttctagcggtggtggcggcagcggtggcggcggtgaaattgtgttaacccagtctccggcgaccctgagcctgagcccgggtgagcgtgccacgctgagctgccgcgcgtctcaatctgtgtcttcttcttatttagcgtggtaccagcaaaaaccgggtcaagcgccacgtttattaatttatggcgccagctctcgcgccaccggtatcccagcccgttttagcggtagcggcagcggtaccgattttacgttaaccattagccgcttagaaccggaggacttcgcggtttactattgtcgtcaaggcagccgctggccgtgggccttcggtcagggcaccaaggttgagatcaaa

SEQ ID NO: 1144 - DNA, 762 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttcgtcgcccacgctggttcgactctgcctattatgccccatttgagaattggggccagtggggtcaaggtaccctggtgaccgtttcttctggtggtagctctcgcagcagcagctctggcggcggtggcagcggcggtggcggcgagattgtgctgacccagagcccggcgacgttaagcttatctccgggcgaacgcgcgacgttatcttgccgcgcctctcagtctgtgtctagctcttatctggcctggtaccagcaaaaaccaggtcaggcgccgcgcctgttaatctacggcgcctcttctcgcgcgaccggcatcccggcgcgtttcagcggcagcggttctggcaccgatttcacgctgaccatctctcgcctggagccagaagactttgccgtgtattactgctcttcttacaccagcagctctacgttagtttttggtcagggcaccaaggttgagattaaa

SEQ ID NO: 1145 - DNA, 750 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttagcgacaagtctggttctggtttcctgtattggggtcaatggggccaaggcaccctggttacggttagcagcggcggctcttctcgctcttctagctctggtggcggcggctctggcggcggtggcgaaattgttctgacccaaagcccggcgaccctgagcctgagcccaggtgaacgcgccaccctgagctgtcgtgcctctcaaagcgtttcttctagctacctggcctggtatcaacagaaaccaggtcaggccccgcgcttactgatttatggtgcgtcttctcgcgcgacgggtatcccagcgcgtttttctggcagcggctctggcaccgatttcacgctgaccatttctcgcctggaaccagaggactttgccgtttattactgcgccagctttgacagctcttctttaagcgcgtgggtgttcggtcaaggtaccaaggtggaaattaaa

SEQ ID NO: 1146 - DNA, 735 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttacctacttcggtcgcaaggactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaacagtactatacctctccgaacacgttcggccagggcacgaaggttgagattaaa

SEQ ID NO: 1147 - DNA, 741 bp, Artificial Sequence
  Description of Artificial Sequence: Synthetic polynucleotide
caggtgcagttagttgaaagcggcggtggtgtggtgcaaccgggtcgtagcttacgtttatcttgcgcggcctctggctttacctttagcagctatgcgatgcattgggtgcgtcaggcgccaggtaagggcttagagtgggtggcggttatctcttatgacggtagcaacaagtactacgccgatagcgttaaaggccgcttcacgattagccgcgacaacagcaaaaataccttatacttacagatgaattctttacgcgccgaggatacggccgtttattattgtgttacctacttcggtcgcaaggactactggggccagtggggtcaaggcacgctggtgaccgtttcttctggcggcagcagccgctcttcttcttctggcggtggtggcagcggcggtggcggcgagattgtgctgacgcagagcccagcgaccctgagcctgagcccgggcgagcgcgcgacgttaagctgccgtgccagccaatctgttagctcttcttacctggcctggtatcaacagaagccgggccaagccccgcgcctgttaatctatggcgcgtctagccgcgccacgggcatcccagcccgctttagcggctctggcagcggcacggattttaccttaacgattagccgtttagagccggaagacttcgccgtgtactactgccaagtgtgggacagcagcttagatttatgggttttcggccagggcacgaaggttgagattaaa

SEQ ID NO: 1148 - DNA, 36 bp, Artificial Sequence
  Description of Artificial Sequence: Synthetic oligonucleotide
tggacccagccaggtaatattgtgacgaacggcgcg

SEQ ID NO: 1149 - DNA, 33 bp, Artificial Sequence
  Description of Artificial Sequence: Synthetic oligonucleotide
ggcgatctgttaaagattcagtttggtggtgcg

SEQ ID NO: 1150 - DNA, 27 bp, Artificial Sequence
  Description of Artificial Sequence: Synthetic oligonucleotide
agcatgagccaatctctgagcctggcg

SEQ ID NO: 1151 - DNA, 39 bp, Artificial Sequence
  Description of Artificial Sequence: Synthetic oligonucleotide
agcagcaccgagaactttattaccttagttgatctggtg

SEQ ID NO: 1152 - DNA, 27 bp, Artificial Sequence
  Description of Artificial Sequence: Synthetic oligonucleotide
ggcacccatgttatcgcggcggcgcgt

SEQ ID NO: 1153 - DNA, 42 bp, Artificial Sequence
  Description of Artificial Sequence: Synthetic oligonucleotide
cgtgatgaattcttagcgctgctggttgagcatctgcgcgaa

SEQ ID NO: 1154 - DNA, 27 bp, Artificial Sequence
  Description of Artificial Sequence: Synthetic oligonucleotide
agcgcggaagactacgtgcgtcagagc

SEQ ID NO: 1155 - DNA, 33 bp, Artificial Sequence; identical to SEQ ID NO: 1149
  Description of Artificial Sequence: Synthetic oligonucleotide

SEQ ID NO: 1156 - DNA, 27 bp, Artificial Sequence
  Description of Artificial Sequence: Synthetic oligonucleotide
agcatgagccaatctctgagcctggcg

SEQ ID NO: 1157 - DNA, 39 bp, Artificial Sequence; identical to SEQ ID NO: 1151
  Description of Artificial Sequence: Synthetic oligonucleotide

SEQ ID NO: 1158 - DNA, 27 bp, Artificial Sequence
  Description of Artificial Sequence: Synthetic oligonucleotide
ggcacccatgttatcgcggcggcgcgt

SEQ ID NO: 1159 - DNA, 42 bp, Artificial Sequence; identical to SEQ ID NO: 1153
  Description of Artificial Sequence: Synthetic oligonucleotide

SEQ ID NO: 1160 - DNA, 27 bp, Artificial Sequence
  Description of Artificial Sequence: Synthetic oligonucleotide
agcgcggaagactacgtgcgtcagagc

SEQ ID NO: 1161 - DNA, 51 bp, Artificial Sequence
  Description of Artificial Sequence: Synthetic oligonucleotide
agcatttatcaagaccaggaacagcgcatcctgaaattcctggaggaactg

SEQ ID NO: 1162 - DNA, 48 bp, Artificial Sequence
  Description of Artificial Sequence: Synthetic oligonucleotide
gatattctgaaggttctgtttaaagagttcattgaaatcagcttatgg

SEQ ID NO: 1163 - DNA, 51 bp, Artificial Sequence
  Description of Artificial Sequence: Synthetic oligonucleotide
aaaaccatggtggacgagctgtttgcggagatcgtgcgtcaaatgaattat

SEQ ID NO: 1164 - DNA, 48 bp, Artificial Sequence
  Description of Artificial Sequence: Synthetic oligonucleotide
tttgcggattacaacctgctggatttattactgattcaccaggttctg

SEQ ID NO: 1165 - DNA, 45 bp, Artificial Sequence
  Description of Artificial Sequence: Synthetic oligonucleotide
gaagatggcgttatggcccgtcagctggtttacaccattgccgat

SEQ ID NO: 1166 - DNA, 48 bp, Artificial Sequence
  Description of Artificial Sequence: Synthetic oligonucleotide
accagcatggcgacgccacatgtgagcggtgttgcgaccttagtgtgg

SEQ ID NO: 1167 - DNA, 36 bp, Artificial Sequence
  Description of Artificial Sequence: Synthetic oligonucleotide
cgtctggatcgctacgcggatctgatccaaaaactg

SEQ ID NO: 1168 - DNA, 60 bp, Artificial Sequence
  Description of Artificial Sequence: Synthetic oligonucleotide
tatgaaaatggtgccatgctggaaccgttatctgtggcgttagcgggtctgcagcgcgcg

SEQ ID NO: 1169 - DNA, 36 bp, Artificial Sequence
  Description of Artificial Sequence: Synthetic oligonucleotide
gaaaaagaaacgaaggaaatggtggcgttcttaaat

SEQ ID NO: 1170 - DNA, 48 bp, Artificial Sequence
  Description of Artificial Sequence: Synthetic oligonucleotide
cgtagcgaagccatccgtgatctgatccgcgattttatcattcgccat

SEQ ID NO: 1171 - DNA, 36 bp, Artificial Sequence
  Description of Artificial Sequence: Synthetic oligonucleotide
accattgatatcttaaccgcgattcgcaacgcgacc

SEQ ID NO: 1172 - DNA, 27 bp, Artificial Sequence
  Description of Artificial Sequence: Synthetic oligonucleotide
gtggatggcgccatccatcgtgcggcg

SEQ ID NO: 1173 - DNA, 36 bp, Artificial Sequence; identical to SEQ ID NO: 1171
  Description of Artificial Sequence: Synthetic oligonucleotide

SEQ ID NO: 1174 - DNA, 54 bp, Artificial Sequence
  Description of Artificial Sequence: Synthetic oligonucleotide
tatcagtatttagccgcgcgtctggccatctttcatttacgtaagaaagcgtat

SEQ ID NO: 1175 - DNA, 48 bp, Artificial Sequence
  Description of Artificial Sequence: Synthetic oligonucleotide
gtgggcccggccatcgcgcgtgatatcatcaatctgtacaatcaacat

SEQ ID NO: 1176 - DNA, 60 bp, Artificial Sequence
  Description of Artificial Sequence: Synthetic oligonucleotide
gatatgattttcgagatttttaaaaactacctgaccaaggtggcctattatgcccgtcag

SEQ ID NO: 1177 - DNA, 60 bp, Artificial Sequence
  Description of Artificial Sequence: Synthetic oligonucleotide
ctgggcgaatggatcgccctgaatgtgttcgagttttttacgaatttaaatcagttctat

SEQ ID NO: 1178 - DNA, 33 bp, Artificial Sequence
  Description of Artificial Sequence: Synthetic oligonucleotide
tttgcgtttgccttacgtaaagcgcaagacacc

SEQ ID NO: 1179 - DNA, 54 bp, Artificial Sequence
  Description of Artificial Sequence: Synthetic oligonucleotide
ggcgaagaattaatcctgaaaggcatcgaggcgtttaagaattggttaaaaaaa

SEQ ID NO: 1180 - DNA, 33 bp, Artificial Sequence; identical to SEQ ID NO: 1178
  Description of Artificial Sequence: Synthetic oligonucleotide

SEQ ID NO: 1181 - DNA, 48 bp, Artificial Sequence
  Description of Artificial Sequence: Synthetic oligonucleotide
catcgtgaattagttcatccggatgccttaaatcgtttcggcaagacc

SEQ ID NO: 1182 - DNA, 57 bp, Artificial Sequence
  Description of Artificial Sequence: Synthetic oligonucleotide
acccgtaaagccttaaattatgtgccaaagctgtttgaggaattacgtaaaacgtat

SEQ ID NO: 1183 - DNA, 51 bp, Artificial Sequence
  Description of Artificial Sequence: Synthetic oligonucleotide
cgtgaaaatgttgaccgtgtgaccgaggccctgcgtgccgcgttacagcat

SEQ ID NO: 1184 - DNA, 51 bp, Artificial Sequence; identical to SEQ ID NO: 1161
  Description of Artificial Sequence: Synthetic oligonucleotide

SEQ ID NO: 1185 - DNA, 54 bp, Artificial Sequence
  Description of Artificial Sequence: Synthetic oligonucleotide
accgaaaaatacttagattttatgccgaagttatttgatgccgtgcgcaataaa

SEQ ID NO: 1186 - DNA, 48 bp, Artificial Sequence; identical to SEQ ID NO: 1162
  Description of Artificial Sequence: Synthetic oligonucleotide

SEQ ID NO: 1187 - DNA, 51 bp, Artificial Sequence; identical to SEQ ID NO: 1163
  Description of Artificial Sequence: Synthetic oligonucleotide

SEQ ID NO: 1188 - DNA, 57 bp, Artificial Sequence
  Description of Artificial Sequence: Synthetic oligonucleotide
ggcgcggtgtctttagcgagcatgctgacggagatttttttactgcaacaggcgcag

SEQ ID NO: 1189 - DNA, 57 bp, Artificial Sequence
  Description of Artificial Sequence: Synthetic oligonucleotide
ccggcgttttacttaaccgcgagccaacaacgttgggaagagtatttaaaaaaaggc

SEQ ID NO: 1190 - DNA, 45 bp, Artificial Sequence; identical to SEQ ID NO: 1165
  Description of Artificial Sequence: Synthetic oligonucleotide

SEQ ID NO: 1191 - DNA, 48 bp, Artificial Sequence; identical to SEQ ID NO: 1166
  Description of Artificial Sequence: Synthetic oligonucleotide

SEQ ID NO: 1192 - DNA, 36 bp, Artificial Sequence; identical to SEQ ID NO: 1167
  Description of Artificial Sequence: Synthetic oligonucleotide

SEQ ID NO: 1193 - DNA, 60 bp, Artificial Sequence; identical to SEQ ID NO: 1168
  Description of Artificial Sequence: Synthetic oligonucleotide

SEQ ID NO: 1194 - DNA, 36 bp, Artificial Sequence; identical to SEQ ID NO: 1169
  Description of Artificial Sequence: Synthetic oligonucleotide

SEQ ID NO: 1195 - DNA, 48 bp, Artificial Sequence; identical to SEQ ID NO: 1170
  Description of Artificial Sequence: Synthetic oligonucleotide

SEQ ID NO: 1196 - DNA, 36 bp, Artificial Sequence; identical to SEQ ID NO: 1171
  Description of Artificial Sequence: Synthetic oligonucleotide

SEQ ID NO: 1197 - DNA, 27 bp, Artificial Sequence
  Description of Artificial Sequence: Synthetic oligonucleotide
gtggatggcgccatccatcgtgcggcg

SEQ ID NO: 1198 - DNA, 36 bp, Artificial Sequence; identical to SEQ ID NO: 1171
  Description of Artificial Sequence: Synthetic oligonucleotide

SEQ ID NO: 1199 - DNA, 60 bp, Artificial Sequence
  Description of Artificial Sequence: Synthetic oligonucleotide
agcctgtattctggtagcaaaggcgccgttgatagcttcgtgcgcattttttctaaagat

SEQ ID NO: 1200 - DNA, 48 bp, Artificial Sequence; identical to SEQ ID NO: 1175
  Description of Artificial Sequence: Synthetic oligonucleotide

SEQ ID NO: 1201 - DNA, 60 bp, Artificial Sequence; identical to SEQ ID NO: 1176
  Description of Artificial Sequence: Synthetic oligonucleotide

SEQ ID NO: 1202 - DNA, 60 bp, Artificial Sequence; identical to SEQ ID NO: 1177
  Description of Artificial Sequence: Synthetic oligonucleotide

SEQ ID NO: 1203 - DNA, 33 bp, Artificial Sequence; identical to SEQ ID NO: 1178
  Description of Artificial Sequence: Synthetic oligonucleotide

SEQ ID NO: 1204 - DNA, 57 bp, Artificial Sequence
  Description of Artificial Sequence: Synthetic oligonucleotide
gcgcagcgtcgcaagatggcgcaggaaaacccaaaaatgcataacagcgagattctg

SEQ ID NO: 1205 - DNA, 33 bp, Artificial Sequence; identical to SEQ ID NO: 1178
  Description of Artificial Sequence: Synthetic oligonucleotide

SEQ ID NO: 1206 - DNA, 48 bp, Artificial Sequence
  Description of Artificial Sequence: Synthetic oligonucleotide
aaactgaaagacttaagccgttttgacgccagctttttcggcgttcat

SEQ ID NO: 1207 - DNA, 48 bp, Artificial Sequence; identical to SEQ ID NO: 1181
  Description of Artificial Sequence: Synthetic oligonucleotide

SEQ ID NO: 1208 - DNA, 57 bp, Artificial Sequence; identical to SEQ ID NO: 1182
  Description of Artificial Sequence: Synthetic oligonucleotide

SEQ ID NO: 1209 - DNA, 54 bp, Artificial Sequence
  Description of Artificial Sequence: Synthetic oligonucleotide
gcgaaaggccgcgaggaagaagcgcgcaagctgctgcgctggggccaacagaat

SEQ ID NO: 1210 - DNA, 42 bp, Artificial Sequence
  Description of Artificial Sequence: Synthetic oligonucleotide
cagaccagcttagacgcggcgcagacgttaattcgtggtgcg

SEQ ID NO: 1211 - DNA, 30 bp, Artificial Sequence
  Description of Artificial Sequence: Synthetic oligonucleotide
ctgccgctggttgactttattattcaaaat

SEQ ID NO: 1212 - DNA, 36 bp, Artificial Sequence
  Description of Artificial Sequence: Synthetic oligonucleotide
agcagcgtggttcgcggcaaaatggatggtggttgg

SEQ ID NO: 1213 - DNA, 42 bp, Artificial Sequence
  Description of Artificial Sequence: Synthetic oligonucleotide
cgtgataccatcatcaataccctgaagaaggcgagcaagctg

SEQ ID NO: 1214 - DNA, 39 bp, Artificial Sequence
  Description of Artificial Sequence: Synthetic oligonucleotide
catggcgatttacaacgttggcagagcgccttagatgcg

SEQ ID NO: 1215 - DNA, 30 bp, Artificial Sequence
  Description of Artificial Sequence: Synthetic oligonucleotide
gatggcgaaatcaaggaactgctggagaaa

SEQ ID NO: 1216 - DNA, 42 bp, Artificial Sequence
  Description of Artificial Sequence: Synthetic oligonucleotide
gcgatggtgttagagagcgtgatgtttgccatcctggcggaa

SEQ ID NO: 1217 - DNA, 30 bp, Artificial Sequence
  Description of Artificial Sequence: Synthetic oligonucleotide
ctgcgtctgttcgttcgtattggcgccatg

SEQ ID NO: 1218 - DNA, 33 bp, Artificial Sequence
  Description of Artificial Sequence: Synthetic oligonucleotide
ccgattaaagccttaatgcgttatagcgagaat

SEQ ID NO: 1219 - DNA, 39 bp, Artificial Sequence
  Description of Artificial Sequence: Synthetic oligonucleotide
ggcccgcaggttggttatctgagcgaggcctttgaagcg

SEQ ID NO: 1220 - DNA, 36 bp, Artificial Sequence
  Description of Artificial Sequence: Synthetic oligonucleotide
aaaagcgtgatcgaggcgctgaaacacggtggcctg

SEQ ID NO: 1221 - DNA, 42 bp, Artificial Sequence
  Description of Artificial Sequence: Synthetic oligonucleotide
ccggatgcgcaaaacgcgctgctgtcttctctgagcgagcag

SEQ ID NO: 1222 - DNA, 33 bp, Artificial Sequence
  Description of Artificial Sequence: Synthetic oligonucleotide
accaatgcggacttactggcgcgtgccgccagc

SEQ ID NO: 1223 - DNA, 30 bp, Artificial Sequence
  Description of Artificial Sequence: Synthetic oligonucleotide
aatgcgggcgccttagcggtgcatcaactg

SEQ ID NO: 1224 - DNA, 36 bp, Artificial Sequence
  Description of Artificial Sequence: Synthetic oligonucleotide
attccggaagccttacgtctgctgttacaagcgctg

SEQ ID NO: 1225 - DNA, 36 bp, Artificial Sequence
  Description of Artificial Sequence: Synthetic oligonucleotide
ccggtgggcttagccgcggcggcgtctgcccgtctg

SEQ ID NO: 1226 - DNA, 36 bp, Artificial Sequence
  Description of Artificial Sequence: Synthetic oligonucleotide
tttgcggcgatcgagagcgtggcgaagaacattcag

SEQ ID NO: 1227 - DNA, 33 bp, Artificial Sequence
  Description of Artificial Sequence: Synthetic oligonucleotide
gtggaagaagacgttcagctgctgaaggacctg

SEQ ID NO: 1228 - DNA, 39 bp, Artificial Sequence
  Description of Artificial Sequence: Synthetic oligonucleotide
catctggaattattactgcgtgatttagaggatagccgt

SEQ ID NO: 1229 - DNA, 39 bp, Artificial Sequence
  Description of Artificial Sequence: Synthetic oligonucleotide
aaaattgcgcaacacaccgcggattacgaggaacgtttt

SEQ ID NO: 1230 - DNA, 39 bp, Artificial Sequence
  Description of Artificial Sequence: Synthetic oligonucleotide
agcggcgtggccgccctgattaaagttttactgagcctg

SEQ ID NO: 1231 - DNA, 45 bp, Artificial Sequence
  Description of Artificial Sequence: Synthetic oligonucleotide
accgcgcgtgcccgcaaatttgcgaaccgcattcatggtcgtttt

SEQ ID NO: 1232 - DNA, 36 bp, Artificial Sequence
  Description of Artificial Sequence: Synthetic oligonucleotide
agctttctggcccgcaatcgtctggttatcgcgctg

SEQ ID NO: 1233 - DNA, 30 bp, Artificial Sequence
  Description of Artificial Sequence: Synthetic oligonucleotide
gcggcggaagccgccaaagtggcgttagaa

SEQ ID NO: 1234 - DNA, 39 bp, Artificial Sequence
  Description of Artificial Sequence: Synthetic oligonucleotide
aatattggcgcctctctggcgaaacgcttagaacagacc

SEQ ID NO: 1235 - DNA, 42 bp, Artificial Sequence
  Description of Artificial Sequence: Synthetic oligonucleotide
gaagcggatatcaaggaacgtaaagagttactgcgtaagttt

SEQ ID NO: 1236 - DNA, 30 bp, Artificial Sequence; identical to SEQ ID NO: 1215
  Description of Artificial Sequence: Synthetic oligonucleotide

SEQ ID NO: 1237 - DNA, 42 bp, Artificial Sequence
  Description of Artificial Sequence: Synthetic oligonucleotide
gcggcgcgtatggccacgtatatggataccatcgactatttt

SEQ ID NO: 1238 - DNA, 27 bp, Artificial Sequence
  Description of Artificial Sequence: Synthetic oligonucleotide
gaatttctgttaacgggcgtgctgaaa

SEQ ID NO: 1239 - DNA, 27 bp, Artificial Sequence
  Description of Artificial Sequence: Synthetic oligonucleotide
gcgctgggcacgatccgtgatattatt

SEQ ID NO: 1240 - DNA, 30 bp, Artificial Sequence
  Description of Artificial Sequence: Synthetic oligonucleotide
ccggtggatgttatcaccgcgattaaggcg

SEQ ID NO: 1241 - DNA, 36 bp, Artificial Sequence
  Description of Artificial Sequence: Synthetic oligonucleotide
tggaatatgctgcgcggtaatgcgacccaagccgcg

SEQ ID NO: 1242 - DNA, 42 bp, Artificial Sequence
  Description of Artificial Sequence: Synthetic oligonucleotide
agcgaaccggcctgggccaccgcgctgtctgtttttgcggcg

SEQ ID NO: 1243 - DNA, 33 bp, Artificial Sequence
  Description of Artificial Sequence: Synthetic oligonucleotide
agcgcggcggccaagaaactgattaacgactat

SEQ ID NO: 1244 - DNA, 24 bp, Artificial Sequence
  Description of Artificial Sequence: Synthetic oligonucleotide
agcgcggaaatcttaagcgcgagc

SEQ ID NO: 1245 - DNA, 39 bp, Artificial Sequence
  Description of Artificial Sequence: Synthetic oligonucleotide
gatggcaccttcttacgtgcggcggagttagcgcgtaat

SEQ ID NO: 1246 - DNA, 24 bp, Artificial Sequence
  Description of Artificial Sequence: Synthetic oligonucleotide
cgtaccgaattaatgcaagcgagc

SEQ ID NO: 1247 - DNA, 33 bp, Artificial Sequence
  Description of Artificial Sequence: Synthetic oligonucleotide
cagcagaatttaatcctgcattatcaagccgtg

SEQ ID NO: 1248 - DNA, 39 bp, Artificial Sequence
  Description of Artificial Sequence: Synthetic oligonucleotide
gcgcgtgcgtactacctgctgggcttagcctatgatggc

SEQ ID NO: 1249 - DNA, 36 bp, Artificial Sequence
  Description of Artificial Sequence: Synthetic oligonucleotide
accgaaattgccgttgatattgcgcgctctgtggaa

SEQ ID NO: 1250 - DNA, 33 bp, Artificial Sequence
  Description of Artificial Sequence: Synthetic oligonucleotide
cagcagggccaagccctggcggcgacggccaat

SEQ ID NO: 1251 - DNA, 30 bp, Artificial Sequence
  Description of Artificial Sequence: Synthetic oligonucleotide
agccaggatatccgcgcgctggcggacgcg

SEQ ID NO: 1252 - DNA, 24 bp, Artificial Sequence
  Description of Artificial Sequence: Synthetic oligonucleotide
ggctatagcttagttgcgcgtaaa

SEQ ID NO: 1253 - DNA, 30 bp, Artificial Sequence
  Description of Artificial Sequence: Synthetic oligonucleotide
tggccgaaagagcgcgatgcggcgacgctg

SEQ ID NO: 1254 - DNA, 27 bp, Artificial Sequence
  Description of Artificial Sequence: Synthetic oligonucleotide
attccgcatgttcaacgtctgattggc

SEQ ID NO: 1255 - DNA, 24 bp, Artificial Sequence
  Description of Artificial Sequence: Synthetic oligonucleotide
gatctggcggttgttaaagcggcg

SEQ ID NO: 1256 - DNA, 42 bp, Artificial Sequence
  Description of Artificial Sequence: Synthetic oligonucleotide
accccgggcatgatcatggccagcgaagcgttattacgtaaa

SEQ ID NO: 1257 - DNA, 39 bp, Artificial Sequence
  Description of Artificial Sequence: Synthetic oligonucleotide
gcggaacagttcatcggcatgagcggctctggttatagc

SEQ ID NO: 1258 - DNA, 36 bp, Artificial Sequence
  Description of Artificial Sequence: Synthetic oligonucleotide
aaagaagaaatcgaggaagtggtgtctgagaccgtg

SEQ ID NO: 1259 - DNA, 39 bp, Artificial Sequence
  Description of Artificial Sequence: Synthetic oligonucleotide
caggaaggcatgtaccaacattttaaagccatcgcggaa

SEQ ID NO: 1260 - DNA, 24 bp, Artificial Sequence
  Description of Artificial Sequence: Synthetic oligonucleotide
gcgagcctggccgccctggcgctg

SEQ ID NO: 1261 - DNA, 42 bp, Artificial Sequence
  Description of Artificial Sequence: Synthetic oligonucleotide
agccgtgcgacgttagcgaatattgaccgcgcgcgtgagcag

SEQ ID NO: 1262 - DNA, 30 bp, Artificial Sequence
  Description of Artificial Sequence: Synthetic oligonucleotide
aatgtggcggacatcattcgtcgtgtttgg

SEQ ID NO: 1263 - DNA, 27 bp, Artificial Sequence
  Description of Artificial Sequence: Synthetic oligonucleotide
attctggatgcctctctggaactgttt

SEQ ID NO: 1264 - DNA, 33 bp, Artificial Sequence
  Description of Artificial Sequence: Synthetic oligonucleotide
aaaacccagttaatcgatgtgattgccgagaaa

SEQ ID NO: 1265 - DNA, 30 bp, Artificial Sequence
  Description of Artificial Sequence: Synthetic oligonucleotide
attgaagcgttcttccgtctggtgaagcgt

SEQ ID NO: 1266 - DNA, 39 bp, Artificial Sequence
  Description of Artificial Sequence: Synthetic oligonucleotide
gcggaagaaaagtctcgtgcgcgtcgccacctgcgtacc

SEQ ID NO: 1267 - DNA, 30 bp, Artificial Sequence
  Description of Artificial Sequence: Synthetic oligonucleotide
cgtgatgaaatcttcgcgaccattaacgaa

SEQ ID NO: 1268 - DNA, 33 bp, Artificial Sequence
  Description of Artificial Sequence: Synthetic oligonucleotide
ctggcgagccgcttctttgcgatgaaacgcagc

SEQ ID NO: 1269 - DNA, 39 bp, Artificial Sequence
  Description of Artificial Sequence: Synthetic oligonucleotide
caggtgaccatcgacagcgcgctggccacgcagaaatat

SEQ ID NO: 1270 - DNA, 33 bp, Artificial Sequence
  Description of Artificial Sequence: Synthetic oligonucleotide
agctttgtgttacaaaaaattgtgtctgccatt

SEQ ID NO: 1271 - DNA, 33 bp, Artificial Sequence
  Description of Artificial Sequence: Synthetic oligonucleotide
gatgtgatgaaaaaggccagcgaactgcaaaaa

SEQ ID NO: 1272 - DNA, 39 bp, Artificial Sequence
  Description of Artificial Sequence: Synthetic oligonucleotide
tggggcgcgttacgctatattcgtgacttagcggcggat

SEQ ID NO: 1273 - DNA, 30 bp, Artificial Sequence
  Description of Artificial Sequence: Synthetic oligonucleotide
cgtaaaattatgtctttaagcaataaactg

SEQ ID NO: 1274 - DNA, 27 bp, Artificial Sequence
  Description of Artificial Sequence: Synthetic oligonucleotide
caggaagatttagcccgtgaaaaagcg

SEQ ID NO: 1275 - DNA, 33 bp, Artificial Sequence
  Description of Artificial Sequence: Synthetic oligonucleotide
ccgctggcgggtatcctgtttattatcgaggaa

SEQ ID NO: 1276 - DNA, 42 bp, Artificial Sequence
  Description of Artificial Sequence: Synthetic oligonucleotide
gcggaagaaaagttcaaagaaattgccgaggcgtatgacgtg

SEQ ID NO: 1277 - DNA, 36 bp, Artificial Sequence
  Description of Artificial Sequence: Synthetic oligonucleotide
aaagtgaaacaagccgatgcgctgtcttctaaaacc

SEQ ID NO: 1278 - DNA, 39 bp, Artificial Sequence
  Description of Artificial Sequence: Synthetic oligonucleotide
agccagggccaatcttatggcatgttttctgccctggcg

SEQ ID NO: 1279 - DNA, 30 bp, Artificial Sequence
  Description of Artificial Sequence: Synthetic oligonucleotide
caggaagcggcccaaaaagtggtggagcag

SEQ ID NO: 1280 - DNA, 27 bp, Artificial Sequence
  Description of Artificial Sequence: Synthetic oligonucleotide
ggccaggcggccgccgcgaccctgctg

SEQ ID NO: 1281 - DNA, 30 bp, Artificial Sequence
  Description of Artificial Sequence: Synthetic oligonucleotide
gaagcgattttagccgcgaaagcggccggc

SEQ ID NO: 1282 - DNA, 36 bp, Artificial Sequence
  Description of Artificial Sequence: Synthetic oligonucleotide
gaatatgcgcgcatcctggaagaacgcgccaccagc

SEQ ID NO: 1283 - DNA, 30 bp, Artificial Sequence
  Description of Artificial Sequence: Synthetic oligonucleotide
cagggcattatcgaccattttcagaaggcg

SEQ ID NO: 1284 - DNA, 30 bp, Artificial Sequence
  Description of Artificial Sequence: Synthetic oligonucleotide
gatattgcgttatggtctggcctggcgggc

SEQ ID NO: 1285 - DNA, 36 bp, Artificial Sequence
  Description of Artificial Sequence: Synthetic oligonucleotide
gcgaaagcgcactacgatggcattgttgcctttagc

SEQ ID NO: 1286 - DNA, 42 bp, Artificial Sequence; identical to SEQ ID NO: 1237
  Description of Artificial Sequence: Synthetic oligonucleotide

SEQ ID NO: 1287 - DNA, 42 bp, Artificial Sequence
  Description of Artificial Sequence: Synthetic oligonucleotide
gtgccgcaggccatgacggcgtttgcggagttcctgaatcgt

SEQ ID NO: 1288 - DNA, 39 bp, Artificial Sequence
  Description of Artificial Sequence: Synthetic oligonucleotide
acctggtatcgcacgattcaggatcgcacgattaccgat

SEQ ID NO: 1289 - DNA, 30 bp, Artificial Sequence
  Description of Artificial Sequence: Synthetic oligonucleotide
cagcgtgatttattaatgtatgcggtgggc

SEQ ID NO: 1290 - DNA, 39 bp, Artificial Sequence
  Description of Artificial Sequence: Synthetic oligonucleotide
accggcgcgttaggtctgattagcgactggttactgacc

SEQ ID NO: 1291 - DNA, 30 bp, Artificial Sequence
  Description of Artificial Sequence: Synthetic oligonucleotide
ccggtgaccacgggtttttatgaagccatt

SEQ ID NO: 1292 - DNA, 36 bp, Artificial Sequence
  Description of Artificial Sequence: Synthetic oligonucleotide
ctgattcgtatgttcaagcgtctggaagagttagtg

SEQ ID NO: 1293 - DNA, 36 bp, Artificial Sequence
  Description of Artificial Sequence: Synthetic oligonucleotide
ggcttttttacggcccagaccctgcacgttgcggtg

SEQ ID NO: 1294 - DNA, 39 bp, Artificial Sequence
  Description of Artificial Sequence: Synthetic oligonucleotide
ttttatccggccgccgcgtttattgaccgcgcgctgagc

SEQ ID NO: 1295 - DNA, 54 bp, Artificial Sequence
  Description of Artificial Sequence: Synthetic oligonucleotide
agcgaagaagaggcccgtctgaaaaagtctgcggatacgctgtggggtattcag

SEQ ID NO: 1296 - DNA, 36 bp, Artificial Sequence
  Description of Artificial Sequence: Synthetic oligonucleotide
accattccggttttactggatattgccgagcgtacc

SEQ ID NO: 1297 - DNA, 39 bp, Artificial Sequence
  Description of Artificial Sequence: Synthetic oligonucleotide
ccgctgctgaaggccagcattaaagagacgctgcgtctg

SEQ ID NO: 1298 - DNA, 42 bp, Artificial Sequence
  Description of Artificial Sequence: Synthetic oligonucleotide
cgtggcgatgccgaggtggtgatttctgagtgggatcaggtg

SEQ ID NO: 1299 - DNA, 33 bp, Artificial Sequence
  Description of Artificial Sequence: Synthetic oligonucleotide
attgaagatgttatccaggcgaatgttaaggcg

SEQ ID NO: 1300 - DNA, 30 bp, Artificial Sequence
  Description of Artificial Sequence: Synthetic oligonucleotide
aataccctggaggagattatttttaagctg

SEQ ID NO: 1301 - DNA, 27 bp, Artificial Sequence
  Description of Artificial Sequence: Synthetic oligonucleotide
cgtgcggcgacggttggcagcctggcg

SEQ ID NO: 1302 - DNA, 60 bp, Artificial Sequence
  Description of Artificial Sequence: Synthetic oligonucleotide
tggcgtgaaatcttagaacgtgatgttcgcaatattatcacctactttagccgcacctat

SEQ ID NO: 1303 - DNA, 24 bp, Artificial Sequence
  Description of Artificial Sequence: Synthetic oligonucleotide
ccgaccattgccttcgcgcatgat

SEQ ID NO: 1304 - DNA, 24 bp, Artificial Sequence
  Description of Artificial Sequence: Synthetic oligonucleotide
gcgaatgtgtctgccgcgattagc

SEQ ID NO: 1305 - DNA, 27 bp, Artificial Sequence
  Description of Artificial Sequence: Synthetic oligonucleotide
ggcctggaagaggttctgtatgaactg

SEQ ID NO: 1306 - DNA, 36 bp, Artificial Sequence
  Description of Artificial Sequence: Synthetic oligonucleotide
gataccctgcgcgcccgtgcggtggccgccgcgcgt

SEQ ID NO: 1307 - DNA, 33 bp, Artificial Sequence
  Description of Artificial Sequence: Synthetic oligonucleotide
ccgagcaaaacgttaatggataattatgaggtg

SEQ ID NO: 1308 - DNA, 42 bp, Artificial Sequence
  Description of Artificial Sequence: Synthetic oligonucleotide
gatcaggaagccgttaccgcgattgagaagtttgtggacgat

SEQ ID NO: 1309 - DNA, 27 bp, Artificial Sequence
  Description of Artificial Sequence: Synthetic oligonucleotide
ccggaagcggccgacatggtgtttacc

SEQ ID NO: 1310 - DNA, 33 bp, Artificial Sequence
  Description of Artificial Sequence: Synthetic oligonucleotide
agcgcgagccaagccgaacagtttttaaagctg

SEQ ID NO: 1311 - DNA, 36 bp, Artificial Sequence
  Description of Artificial Sequence: Synthetic oligonucleotide
gcgtttcgtgagatgtctgatatgattctgcaagcg

SEQ ID NO: 1312 - DNA, 27 bp, Artificial Sequence
  Description of Artificial Sequence: Synthetic oligonucleotide
accaatagcatgcgcatgatgcaacag

SEQ ID NO: 1313 - DNA, 33 bp, Artificial Sequence
  Description of Artificial Sequence: Synthetic oligonucleotide
ggcccggaaggtatgacgagctttatgcgtagc

SEQ ID NO: 1314 - DNA, 30 bp, Artificial Sequence
  Description of Artificial Sequence: Synthetic oligonucleotide
attgaacgtatcaacgaactggtggcctat

SEQ ID NO: 1315 - DNA, 42 bp, Artificial Sequence
  Description of Artificial Sequence: Synthetic oligonucleotide
catctgctggaccaatttgcgaccgccatgatcgaacgtacc

SEQ ID NO: 1316 - DNA, 24 bp, Artificial Sequence
  Description of Artificial Sequence: Synthetic oligonucleotide
gtgaccgaaatcgccaaaaaactg

SEQ ID NO: 1317 - DNA, 45 bp, Artificial Sequence
  Description of Artificial Sequence: Synthetic oligonucleotide
ggcgcgcaggttcaagcgctggcggacgccgcgctggaggcgttt

SEQ ID NO: 1318 - DNA, 48 bp, Artificial Sequence
  Description of Artificial Sequence: Synthetic oligonucleotide
accgcgagcttattaagcaatgtgacggacgaactgcgccgtatgacc

SEQ ID NO: 1319 - DNA, 54 bp, Artificial Sequence
  Description of Artificial Sequence: Synthetic oligonucleotide
ccgctgctgcaacaaattcataatatcacgagctttatccgtcaagcgaaagcg

SEQ ID NO: 1320 - DNA, 48 bp, Artificial Sequence
  Description of Artificial Sequence: Synthetic oligonucleotide
cgtcataccatcgttaattttgtggagcaaagcctgatcgtggacatg

SEQ ID NO: 1321 - DNA, 48 bp, Artificial Sequence
  Description of Artificial Sequence: Synthetic oligonucleotide
caggcgcatgccgaggcgtgggcggcgttacgccatctggccgaacgt

SEQ ID NO: 1322 - DNA, 54 bp, Artificial Sequence
  Description of Artificial Sequence: Synthetic oligonucleotide
attgtggatttattacagattgtgaaccaaattacccaaaaattacgtcagatt

SEQ ID NO: 1323 - DNA, 48 bp, Artificial Sequence
  Description of Artificial Sequence: Synthetic oligonucleotide
gcggcggatttaaaggcggtgcaggacaagctgaaaacgtttgttgaa

SEQ ID NO: 1324 - DNA, 48 bp, Artificial Sequence
  Description of Artificial Sequence: Synthetic oligonucleotide
cagaccgcgtctcacgcgctggatgccgccctggaattagcggccgat

SEQ ID NO: 1325 - DNA, 54 bp, Artificial Sequence
  Description of Artificial Sequence: Synthetic oligonucleotide
caggcgtttgttgacgcgacctggccgcaagccgcgaaagccgcgcaaagcctg

SEQ ID NO: 1326 - DNA, 51 bp, Artificial Sequence
  Description of Artificial Sequence: Synthetic oligonucleotide
cgtggccatcaaaagctgattaatgccacggtggaaaaggcgcgcgaagtg

SEQ ID NO: 1327 - DNA, 54 bp, Artificial Sequence
  Description of Artificial Sequence: Synthetic oligonucleotide
gcgagcattttcttcgcgattaaagacgccattcgtgccgcgcgcgcgcagcat

SEQ ID NO: 1328 - DNA, 48 bp, Artificial Sequence
  Description of Artificial Sequence: Synthetic oligonucleotide
gaacaggaacaccgcaaacgtgtgatccgcgaactgaacagcttaatt

SEQ ID NO: 1329 - DNA, 45 bp, Artificial Sequence
  Description of Artificial Sequence: Synthetic oligonucleotide
gcgccggcgcgcttacattggctggcgacgttactgatggatgcg

SEQ ID NO: 1330 - DNA, 48 bp, Artificial Sequence
  Description of Artificial Sequence: Synthetic oligonucleotide
aaaggctttcacgccattcagacccaccgcctggcgcactggctgtat

SEQ ID NO: 1331 - DNA, 48 bp, Artificial Sequence
  Description of Artificial Sequence: Synthetic oligonucleotide
ctgaaagatttagttcgtaaagcggaggagattggccgcgaattaagc

SEQ ID NO: 1332 - DNA, 54 bp, Artificial Sequence; identical to SEQ ID NO: 1174
  Description of Artificial Sequence: Synthetic oligonucleotide

SEQ ID NO: 1333 - DNA, 45 bp, Artificial Sequence
  Description of Artificial Sequence: Synthetic oligonucleotide
ccggtgggcgacgttaaagaactgggtgccattcaggaggtgttt

SEQ ID NO: 1334 - DNA, 54 bp, Artificial Sequence
  Description of Artificial Sequence: Synthetic oligonucleotide
acccaggcgttattacgttttctggccgaccatagccgcagcaaggataccgtg

SEQ ID NO: 1335 - DNA, 54 bp, Artificial Sequence
  Description of Artificial Sequence: Synthetic oligonucleotide
ggccgtgatttagccctgctgggccgcttctatgcggaggcgttagtggatagc

SEQ ID NO: 1336 - DNA, 48 bp, Artificial Sequence
  Description of Artificial Sequence: Synthetic oligonucleotide
gcggaactgcgctctaccttttttcgcgccctgagcgacgcgcaaaat

SEQ ID NO: 1337 - DNA, 60 bp, Artificial Sequence
  Description of Artificial Sequence: Synthetic oligonucleotide
ccgcgtgaagaggagcgtctgaaagcctctgcgaaagcccgttctcgtaccttacaggaa

SEQ ID NO: 1338 - DNA, 51 bp, Artificial Sequence
  Description of Artificial Sequence: Synthetic oligonucleotide
caggaacaggcccaagcgggcgaagacaacctgggcgcccaggccgcggcg

SEQ ID NO: 1339 - DNA, 54 bp, Artificial Sequence
  Description of Artificial Sequence: Synthetic oligonucleotide
gtggatgaattaatgatgcgcctgatggcggcgatggagatctttaccgcccag

SEQ ID NO: 1340 - DNA, 39 bp, Artificial Sequence
  Description of Artificial Sequence: Synthetic oligonucleotide
gaaatggaaacggttattccggtggacgttatgcgtcgt

SEQ ID NO: 1341 - DNA, 54 bp, Artificial Sequence
  Description of Artificial Sequence: Synthetic oligonucleotide
attgcggaaaaggttcagtatatgattgagtggtggacgaaaagcggtgaactg

SEQ ID NO: 1342 - DNA, 57 bp, Artificial Sequence
  Description of Artificial Sequence: Synthetic oligonucleotide
aaagaagtgcgcgccagcgcgaaagccttagtgcagaagtggaccaacgaagtgttt

SEQ ID NO: 1343 - DNA, 48 bp, Artificial Sequence
  Description of Artificial Sequence: Synthetic oligonucleotide
ccggcgatgaaacaaatcaaacgtaaaatccaagaatttcaccgtacc

SEQ ID NO: 1344 - DNA, 57 bp, Artificial Sequence
  Description of Artificial Sequence: Synthetic oligonucleotide
gaaaccacccaagagcgtctgcgttctggttatgaagacgcggttgattataaccgt

SEQ ID NO: 1345 - DNA, 54 bp, Artificial Sequence
  Description of Artificial Sequence: Synthetic oligonucleotide
gtgcaggtggccgaggaagcgattgttaacgcgatgcgtgttctgtactatcgt

SEQ ID NO: 1346 - DNA, 48 bp, Artificial Sequence
  Description of Artificial Sequence: Synthetic oligonucleotide
tatgcgctgggtgttcgtagcggcttacaagaactggccccgcacctg

SEQ ID NO: 1347 - DNA, 36 bp, Artificial Sequence; identical to SEQ ID NO: 1306
  Description of Artificial Sequence: Synthetic oligonucleotide

SEQ ID NO: 1348 - DNA, 60 bp, Artificial Sequence
  Description of Artificial Sequence: Synthetic oligonucleotide
gtggaagaagttcgcgaactgctggagtggtacaataatatgaaccgtttactgaaaatg

SEQ ID NO: 1349 - DNA, 48 bp, Artificial Sequence
  Description of Artificial Sequence: Synthetic oligonucleotide
accgaactgaagcacaccctggaatctgagggccgtgagctggttaaa

SEQ ID NO: 1350 - DNA, 54 bp, Artificial Sequence
  Description of Artificial Sequence: Synthetic oligonucleotide
accgatacctacgttacccgtattcgcgccgcggtgcaagcgcgccagcgtatt

SEQ ID NO: 1351 - DNA, 45 bp, Artificial Sequence
  Description of Artificial Sequence: Synthetic oligonucleotide
agcgaagaacgcgcccatcgtcgtatgttacaactgcaggttaaa

SEQ ID NO: 1352 - DNA, 57 bp, Artificial Sequence
  Description of Artificial Sequence: Synthetic oligonucleotide
accaccaccgccgttgtggtggcgggtgagctgctgcgcaaagccgaagaattactg

SEQ ID NO: 1353 - DNA, 54 bp, Artificial Sequence
  Description of Artificial Sequence: Synthetic oligonucleotide
ggcggcccgttaggtctgatgcaggcggttttagatcatacgattccatatctg

SEQ ID NO: 1354 - DNA, 48 bp, Artificial Sequence
  Description of Artificial Sequence: Synthetic oligonucleotide
attttttatgccgagctggcgcgtggtatcgaagatatcgcgacgatg

SEQ ID NO: 1355 - DNA, 51 bp, Artificial Sequence
  Description of Artificial Sequence: Synthetic oligonucleotide
agcgaagaaatcaagaaaaaagcgttagagtttgtgaagtatatcaatagc

SEQ ID NO: 1356 - DNA, 54 bp, Artificial Sequence
  Description of Artificial Sequence: Synthetic oligonucleotide
gcggaacagttattaagccaggcgcgcgactttattaaccagtactatagcagc

SEQ ID NO: 1357 - DNA, 45 bp, Artificial Sequence
  Description of Artificial Sequence: Synthetic oligonucleotide
attctgcatttagttggcgatgtggttgccctgctggaggcgatt

SEQ ID NO: 1358 - DNA, 60 bp, Artificial Sequence
  Description of Artificial Sequence: Synthetic oligonucleotide
gcggtggcgcgcgccgcgctgattaacatggtttttcagatgggtgaaacgggcgtggcg

SEQ ID NO: 1359 - DNA, 42 bp, Artificial Sequence
  Description of Artificial Sequence: Synthetic oligonucleotide
gcggcgggcatcgccgcgctggcgttctctctgaatgagctg

SEQ ID NO: 1360 - DNA, 51 bp, Artificial Sequence
  Description of Artificial Sequence: Synthetic oligonucleotide
tttgcgcgtgttgttgaaaccgtgtctgaggcgatgagcggtctgttagcg

SEQ ID NO: 1361 - DNA, 48 bp, Artificial Sequence
  Description of Artificial Sequence: Synthetic oligonucleotide
agcgtgaatttattaaaaagccatttagaggaactggccaaaaagcag

SEQ ID NO: 1362 - DNA, 51 bp, Artificial Sequence
  Description of Artificial Sequence: Synthetic oligonucleotide
ccgtttgcgttaaagccgctgattgcctggacggaacgtgagcgtgccgcg

SEQ ID NO: 1363 - DNA, 51 bp, Artificial Sequence
  Description of Artificial Sequence: Synthetic oligonucleotide
gcgcaggcgttcttaagcgaagaacaagcctttgtgaacagcatcctgaat

SEQ ID NO: 1364 - DNA, 57 bp, Artificial Sequence
  Description of Artificial Sequence: Synthetic oligonucleotide
cagcagctgcgcgacgcgattgaagagtacggcaatgccattcgccagctggccgcg

SEQ ID NO: 1365 - DNA, 54 bp, Artificial Sequence
  Description of Artificial Sequence: Synthetic oligonucleotide
gtgccgtttaacatcgcgagctatgccttactgaccatgatgatcgcgcaagtg

SEQ ID NO: 1366 - DNA, 45 bp, Artificial Sequence
  Description of Artificial Sequence: Synthetic oligonucleotide
cgtgatcagatcttactgcgtctgttagccagcgcgttacagatt

SEQ ID NO: 1367 - DNA, 45 bp, Artificial Sequence
  Description of Artificial Sequence: Synthetic oligonucleotide
gcgggcgcgacgatcctgcgtctggccaaggatctggccgaaaat

SEQ ID NO: 1368 - DNA, 57 bp, Artificial Sequence
  Description of Artificial Sequence: Synthetic oligonucleotide
gaagaaggcttacgcatgaatattagcgttggtattcagtacattgccagctggctg

SEQ ID NO: 1369 - DNA, 57 bp, Artificial Sequence
  Description of Artificial Sequence: Synthetic oligonucleotide
aaaagcctgatccaagattatgatgccgagatggcggaatacatgaaaaagcgtacc

SEQ ID NO: 1370 - DNA, 48 bp, Artificial Sequence
  Description of Artificial Sequence: Synthetic oligonucleotide
gtgggcgcggttaaggcggcgaccgacgccggcgcggccgcggcccgt

SEQ ID NO: 1371 - DNA, 54 bp, Artificial Sequence
  Description of Artificial Sequence: Synthetic oligonucleotide
catgcggcggagttagcgaaagcggaggccggcgtggccgaaatggccgcgaaa

SEQ ID NO: 1372 - DNA, 60 bp, Artificial Sequence
  Description of Artificial Sequence: Synthetic oligonucleotide
gaagaagaaaaggagaaatatgcggagatggcccgtgaatggcgcgcggcccagggcaaa

SEQ ID NO: 1373 - DNA, 48 bp, Artificial Sequence; identical to SEQ ID NO: 1321
  Description of Artificial Sequence: Synthetic oligonucleotide

SEQ ID NO: 1374 - DNA, 57 bp, Artificial Sequence
  Description of Artificial Sequence: Synthetic oligonucleotide
cagaatcgtatcgactatctgaaagcccacattggccaagcgtggaaggcgattcag

SEQ ID NO: 1375 - DNA, 54 bp, Artificial Sequence
  Description of Artificial Sequence: Synthetic oligonucleotide
gatgaacagatcgttgataatattgaggccgtgctgaacgtggttgcgaaaaaa

SEQ ID NO: 1376 - DNA, 57 bp, Artificial Sequence
  Description of Artificial Sequence: Synthetic oligonucleotide
gaacgtcatttagaccgtaaagcggagttaattgtgcaagtgcgcattctgttaaaa

SEQ ID NO: 1377 - DNA, 48 bp, Artificial Sequence
  Description of Artificial Sequence: Synthetic oligonucleotide
catcagagcgacgtttggagctttggcgttttactgtgggaaatcttt

SEQ ID NO: 1378 - DNA, 54 bp, Artificial Sequence
  Description of Artificial Sequence: Synthetic oligonucleotide
ctgccggatttagccgcgcgtattttaccacaggcggcccgtgccctgaaagaa

SEQ ID NO: 1379 - DNA, 48 bp, Artificial Sequence
  Description of Artificial Sequence: Synthetic oligonucleotide
ccgtatctgggtgcccagattgcgaaggccatggtgaaaggttatcag

SEQ ID NO: 1380 - DNA, 54 bp, Artificial Sequence
  Description of Artificial Sequence: Synthetic oligonucleotide
gaagaacaggcccgcaaagcgtttgaccgcgcgaccaagctggagcaggaattt

SEQ ID NO: 1381 - DNA, 48 bp, Artificial Sequence
  Description of Artificial Sequence: Synthetic oligonucleotide
tttgtggatttcttagtgtatgatgttttagatctgcaccgtatcttt

SEQ ID NO: 1382 - DNA, 45 bp, Artificial Sequence
  Description of Artificial Sequence: Synthetic oligonucleotide
tatgataaagttatcgaacgtattttagagtttattcgcgaaaaa

SEQ ID NO: 1383 - DNA, 57 bp, Artificial Sequence
  Description of Artificial Sequence: Synthetic oligonucleotide
ggcaaatggtggcgtcgccaactgaatgtgtactggtctcgttggctggttaccgcg

SEQ ID NO: 1384 - DNA, 54 bp, Artificial Sequence
  Description of Artificial Sequence: Synthetic oligonucleotide
catctgccgcgcatcgaacgttatgttcgcctgctggccgaacacctggcggcg

SEQ ID NO: 1385 - DNA, 45 bp, Artificial Sequence
  Description of Artificial Sequence: Synthetic oligonucleotide
ccggaagaatacgagaaaaccctggacgagctggtggcccgtacc

SEQ ID NO: 1386 - DNA, 45 bp, Artificial Sequence
  Description of Artificial Sequence: Synthetic oligonucleotide
gcgagcagcatcatgcaaaccctgttttctcaactgaaacaattt

SEQ ID NO: 1387 - DNA, 54 bp, Artificial Sequence
  Description of Artificial Sequence: Synthetic oligonucleotide
ctgccgtttggtttcgtgagcatgtttttagccccgtggattgagcgtcgcctg

SEQ ID NO: 1388 - DNA, 54 bp, Artificial Sequence
  Description of Artificial Sequence: Synthetic oligonucleotide
ctgagcgaagccttaaaagaagcgacgaaggaagtgcacattcgcgcggaaaat

SEQ ID NO: 1389 - DNA, 54 bp, Artificial Sequence; identical to SEQ ID NO: 1295
  Description of Artificial Sequence: Synthetic oligonucleotide

SEQ ID NO: 1390 - DNA, 45 bp, Artificial Sequence
  Description of Artificial Sequence: Synthetic oligonucleotide
gatagctataacgagagcattgtgaactggttatatcgtcgccat

SEQ ID NO: 1391 - DNA, 54 bp, Artificial Sequence
  Description of Artificial Sequence: Synthetic oligonucleotide
attatgtataagggtcatctgaatttaatgtacggcctgtaccagttagtgacc

SEQ ID NO: 1392 - DNA, 57 bp, Artificial Sequence
  Description of Artificial Sequence: Synthetic oligonucleotide
ggcgcgtattctatcagcgtggcggagcacgcgtttgccctgttactggcgcacgcg

SEQ ID NO: 1393 - DNA, 48 bp, Artificial Sequence
  Description of Artificial Sequence: Synthetic oligonucleotide
gtgcaggtgacgaactatgtggaagaccgcattattgccctgcgcaat

SEQ ID NO: 1394 - DNA, 51 bp, Artificial Sequence
  Description of Artificial Sequence: Synthetic oligonucleotide
tttctgccgttcggttatctggtggaccaatggcgttggggcgtttttagc

SEQ ID NO: 1395 - DNA, 54 bp, Artificial Sequence
  Description of Artificial Sequence: Synthetic oligonucleotide
ccggcgagccgcttcattcgtgtggccttcctgcgtgacgcgatgatcaaaaat

SEQ ID NO: 1396 - DNA, 24 bp, Artificial Sequence
  Description of Artificial Sequence: Synthetic oligonucleotide
tttcaggaattattcggcccgggc

SEQ ID NO: 1397 - DNA, 51 bp, Artificial Sequence
  Description of Artificial Sequence: Synthetic oligonucleotide
tggctgctggaggacgcgaaaggcttattcaatgcgacggtgcgcgatgcg

SEQ ID NO: 1398 - DNA, 48 bp, Artificial Sequence
  Description of Artificial Sequence: Synthetic oligonucleotide
ggcgaacgtgccaagcagctgcgtcgcttcagcattgccaccttacgt

SEQ ID NO: 1399 - DNA, 45 bp, Artificial Sequence
  Description of Artificial Sequence: Synthetic oligonucleotide
ggcaatgcgatctacgaacgtagcttcgccattattcgcgcggaa

SEQ ID NO: 1400 - DNA, 27 bp, Artificial Sequence
  Description of Artificial Sequence: Synthetic oligonucleotide
cgtgaaaaattagagaatctgaccgaa

SEQ ID NO: 1401 - DNA, 27 bp, Artificial Sequence
  Description of Artificial Sequence: Synthetic oligonucleotide
gatgaaaccaagaaggcgcgtatgcag

SEQ ID NO: 1402 - DNA, 27 bp, Artificial Sequence
  Description of Artificial Sequence: Synthetic oligonucleotide
gaaaatcgtgagatcgcgcagcgtgaa

SEQ ID NO: 1403 - DNA, 27 bp, Artificial Sequence
  Description of Artificial Sequence: Synthetic oligonucleotide
gaacgtattaagtctaccctgaaagaa

SEQ ID NO: 1404 - DNA, 27 bp, Artificial Sequence
  Description of Artificial Sequence: Synthetic oligonucleotide
gatgaacagatccgcgaaatgaaaagc

SEQ ID NO: 1405 - DNA, 27 bp, Artificial Sequence
  Description of Artificial Sequence: Synthetic oligonucleotide
gaaaaagaacgcttagaagcgcagacc

SEQ ID NO: 1406 - DNA, 27 bp, Artificial Sequence
  Description of Artificial Sequence: Synthetic oligonucleotide
cgtattcatgagacgaatctgaaaaaa

SEQ ID NO: 1407 - DNA, 27 bp, Artificial Sequence
  Description of Artificial Sequence: Synthetic oligonucleotide
aatgaagaaatcaagaaactgcatacc

SEQ ID NO: 1408 - DNA, 27 bp, Artificial Sequence
  Description of Artificial Sequence: Synthetic oligonucleotide
gatcagcgtaagcaccataccgaaacc

SEQ ID NO: 1409 - DNA, 27 bp, Artificial Sequence
  Description of Artificial Sequence: Synthetic oligonucleotide
cgtgatacccgcgagcgtctgcatacc

SEQ ID NO: 1410 - DNA, 27 bp, Artificial Sequence
  Description of Artificial Sequence: Synthetic oligonucleotide
gatgaaaaacgcatgttaaaaaccacc

SEQ ID NO: 1411 - DNA, 27 bp, Artificial Sequence
  Description of Artificial Sequence: Synthetic oligonucleotide
aatcaggaattaaaggaagtgcgtgat

SEQ ID NO: 1412 - DNA, 27 bp, Artificial Sequence
  Description of Artificial Sequence: Synthetic oligonucleotide
gaaaatctgaagaacctggaaaaacat

SEQ ID NO: 1413 - DNA, 27 bp, Artificial Sequence
  Description of Artificial Sequence: Synthetic oligonucleotide
accgaacatgagaagcaggtgaaagaa

SEQ ID NO: 1414 - DNA, 30 bp, Artificial Sequence
  Description of Artificial Sequence: Synthetic oligonucleotide
agcagcaaagccaaggaactgaaagaccgt

SEQ ID NO: 1415 - DNA, 30 bp, Artificial Sequence
  Description of Artificial Sequence: Synthetic oligonucleotide
aatgataaaatcgaggcgattaaatctcat

SEQ ID NO: 1416 - DNA, 30 bp, Artificial Sequence
  Description of Artificial Sequence: Synthetic oligonucleotide
cgtgaacgtatccgcgaacatctgtctagc

SEQ ID NO: 1417 - DNA, 30 bp, Artificial Sequence
  Description of Artificial Sequence: Synthetic oligonucleotide
cgtgatgtgcaagaccagctgaaagagaaa

SEQ ID NO: 1418 - DNA, 30 bp, Artificial Sequence
  Description of Artificial Sequence: Synthetic oligonucleotide
accagcgaattacgcgaagcgatgcgtaaa

SEQ ID NO: 1419 - DNA, 30 bp, Artificial Sequence
  Description of Artificial Sequence: Synthetic oligonucleotide
cagcaggcggaggacaaaattaaagagctg

SEQ ID NO: 1420 - DNA, 30 bp, Artificial Sequence
  Description of Artificial Sequence: Synthetic oligonucleotide
aaagaaacccaaaagcagctgattgacgat

SEQ ID NO: 1421 - DNA, 30 bp, Artificial Sequence
  Description of Artificial Sequence: Synthetic oligonucleotide
cgtgaaggcaaggaccgtacccgtcaactg

SEQ ID NO: 1422 - DNA, 30 bp, Artificial Sequence
  Description of Artificial Sequence: Synthetic oligonucleotide
gaaaaaattcgccaaaccctggaagacgcg

SEQ ID NO: 1423 - DNA, 30 bp, Artificial Sequence
  Description of Artificial Sequence: Synthetic oligonucleotide
gataaaattatcaagcgtgcgaatgagaat

SEQ ID NO: 1424 - DNA, 30 bp, Artificial Sequence
  Description of Artificial Sequence: Synthetic oligonucleotide
cgtgaaggcgccgagaaaattaatcaaaaa

SEQ ID NO: 1425 - DNA, 30 bp, Artificial Sequence
  Description of Artificial Sequence: Synthetic oligonucleotide
gatgatgtggttaagaaactggattctagc

SEQ ID NO: 1426 - DNA, 30 bp, Artificial Sequence
  Description of Artificial Sequence: Synthetic oligonucleotide
gatcgtacccgcaagctgatggaagtgacc

SEQ ID NO: 1427 - DNA, 30 bp, Artificial Sequence
  Description of Artificial Sequence: Synthetic oligonucleotide
gcggaacatgttcaacagattaaagagcat

SEQ ID NO: 1428 - DNA, 30 bp, Artificial Sequence
  Description of Artificial Sequence: Synthetic oligonucleotide
cgtgatgaattaacgcaggcggcgaagaaa

SEQ ID NO: 1429 - DNA, 30 bp, Artificial Sequence
  Description of Artificial Sequence: Synthetic oligonucleotide
gcgcagcgtatcaaggaaattcaggaccgt

SEQ ID NO: 1430 - DNA, 30 bp, Artificial Sequence
  Description of Artificial Sequence: Synthetic oligonucleotide
gaaaatgaaatccaagcgaaagcgaaggaa

SEQ ID NO: 1431 - DNA, 30 bp, Artificial Sequence
  Description of Artificial Sequence: Synthetic oligonucleotide
agcgatgatatccgcaaactgctggagagc

SEQ ID NO: 1432 - DNA, 30 bp, Artificial Sequence
  Description of Artificial Sequence: Synthetic oligonucleotide
aaagatagcttaaagaaaattcattctatt

SEQ ID NO: 1433 - DNA, 30 bp, Artificial Sequence
  Description of Artificial Sequence: Synthetic oligonucleotide
aaaaaagatatcgacgataccattaagagc

SEQ ID NO: 1434 - DNA, 30 bp, Artificial Sequence
  Description of Artificial Sequence: Synthetic oligonucleotide
aaaaaagaattaaaggaactgctgcaaacc

SEQ ID NO: 1435 - DNA, 30 bp, Artificial Sequence
  Description of Artificial Sequence: Synthetic oligonucleotide
cgtgatctgacggagcgtgcgatgcgtcag

SEQ ID NO: 1436 - DNA, 30 bp, Artificial Sequence
  Description of Artificial Sequence: Synthetic oligonucleotide
attgatacccgcttagaaaaactgaagaat

SEQ ID NO: 1437 - DNA, 30 bp, Artificial Sequence
  Description of Artificial Sequence: Synthetic oligonucleotide
cagattgatgagcaccatgcggtgcgcacc

SEQ ID NO: 1438 - DNA, 30 bp, Artificial Sequence
  Description of Artificial Sequence: Synthetic oligonucleotide
gcggaagaaacgatcaaagaactgaagaat

SEQ ID NO: 1439 - DNA, 30 bp, Artificial Sequence
  Description of Artificial Sequence: Synthetic oligonucleotide
gaaaaagatacggttgatcaggtgcgcatt

SEQ ID NO: 1440 - DNA, 30 bp, Artificial Sequence
  Description of Artificial Sequence: Synthetic oligonucleotide
gatgatgaaacgttacgtaatgtgaagagc

SEQ ID NO: 1441 - DNA, 30 bp, Artificial Sequence
  Description of Artificial Sequence: Synthetic oligonucleotide
cgtgatgaattacaccgtctgctgacgcag

SEQ ID NO: 1442 - DNA, 30 bp, Artificial Sequence
  Description of Artificial Sequence: Synthetic oligonucleotide
aaagaaaaattagaggcgaccattaacgaa

SEQ ID NO: 1443 - DNA, 30 bp, Artificial Sequence
  Description of Artificial Sequence: Synthetic oligonucleotide
gatgaacgtgttcaacagattaaaaagagc

SEQ ID NO: 1444 - DNA, 30 bp, Artificial Sequence
  Description of Artificial Sequence: Synthetic oligonucleotide
cgtgatcagggtaaggaaatggcgaccaaa

SEQ ID NO: 1445 - DNA, 30 bp, Artificial Sequence
  Description of Artificial Sequence: Synthetic oligonucleotide
ctgagcaccgaccgcaaaatggatgaagtg

SEQ ID NO: 1446 - DNA, 30 bp, Artificial Sequence
  Description of Artificial Sequence: Synthetic oligonucleotide
gtggaagatttaacgagcaaagcggagaaa

SEQ ID NO: 1447 - DNA, 30 bp, Artificial Sequence
  Description of Artificial Sequence: Synthetic oligonucleotide
gaagataaattacgcaccattgcgaacgaa

SEQ ID NO: 1448 - DNA, 30 bp, Artificial Sequence
  Description of Artificial Sequence: Synthetic oligonucleotide
cgtgaaaaattattagataccatgaatcgt

SEQ ID NO: 1449 - DNA, 30 bp, Artificial Sequence
  Description of Artificial Sequence: Synthetic oligonucleotide
aatcataatttagagcgtattcgtgagctg

SEQ ID NO: 1450 - DNA, 30 bp, Artificial Sequence
  Description of Artificial Sequence: Synthetic oligonucleotide
gataaaagccgcaagctgctggaatctatt

SEQ ID NO: 1451 - DNA, 30 bp, Artificial Sequence
  Description of Artificial Sequence: Synthetic oligonucleotide
aaaaatgatatcgttgaactgaaaaacaaa

SEQ ID NO: 1452 - DNA, 30 bp, Artificial Sequence
  Description of Artificial Sequence: Synthetic oligonucleotide
cataccgattctcacctgcatacccgccag

SEQ ID NO: 1453 - DNA, 30 bp, Artificial Sequence
  Description of Artificial Sequence: Synthetic oligonucleotide
cagcgtctgcgcacgaaactggaaacggaa

SEQ ID NO: 1454 - DNA, 30 bp, Artificial Sequence
  Description of Artificial Sequence: Synthetic oligonucleotide
gaacgtacccgcgccgatattaaatctgtg

SEQ ID NO: 1455 - DNA, 30 bp, Artificial Sequence
  Description of Artificial Sequence: Synthetic oligonucleotide
ccgcatgtgacggagcgtgtgcagaaggaa

SEQ ID NO: 1456 - DNA, 30 bp, Artificial Sequence
  Description of Artificial Sequence: Synthetic oligonucleotide
gataataaattaaacgaaattggcgagaaa

SEQ ID NO: 1457 - DNA, 30 bp, Artificial Sequence
  Description of Artificial Sequence: Synthetic oligonucleotide
aaaccgaaagccgaccagaaactggagcag

SEQ ID NO: 1458 - DNA, 30 bp, Artificial Sequence
  Description of Artificial Sequence: Synthetic oligonucleotide
agcgcgaaaaagaaggatgtgatttctgaa

SEQ ID NO: 1459 - DNA, 30 bp, Artificial Sequence
  Description of Artificial Sequence: Synthetic oligonucleotide
attaatgaagttaagcagcatctggagcgt

SEQ ID NO: 1460 - DNA, 30 bp, Artificial Sequence
  Description of Artificial Sequence: Synthetic oligonucleotide
aaaaaagaagttgaccaggcgattaagagc

SEQ ID NO: 1461 - DNA, 30 bp, Artificial Sequence
  Description of Artificial Sequence: Synthetic oligonucleotide
gcgaccgatacgcaccgtctgcataaggaa

SEQ ID NO: 1462 - DNA, 30 bp, Artificial Sequence
  Description of Artificial Sequence: Synthetic oligonucleotide
catgcggaacgcttaaaagtgcagaagaat

SEQ ID NO: 1463 - DNA, 30 bp, Artificial Sequence
  Description of Artificial Sequence: Synthetic oligonucleotide
accaaaattcgcgagaaagtgcgttctgat

SEQ ID NO: 1464 - DNA, 30 bp, Artificial Sequence
  Description of Artificial Sequence: Synthetic oligonucleotide
gcggatgatgttaagcagctgaaatctaaa

SEQ ID NO: 1465 - DNA, 30 bp, Artificial Sequence
  Description of Artificial Sequence: Synthetic oligonucleotide
ctgcatcaggttcgcaaaaaactggacagc

SEQ ID NO: 1466 - DNA, 30 bp, Artificial Sequence
  Description of Artificial Sequence: Synthetic oligonucleotide
gaagtggaagttcgccaggcgcgtgacaat

SEQ ID NO: 1467 - DNA, 30 bp, Artificial Sequence
  Description of Artificial Sequence: Synthetic oligonucleotide
catgaaaaacacacgaccgcgctggagaaa

SEQ ID NO: 1468 - DNA, 30 bp, Artificial Sequence
  Description of Artificial Sequence: Synthetic oligonucleotide
aaagaagatgttcaagcgagcctggagcgt

SEQ ID NO: 1469 - DNA, 30 bp, Artificial Sequence
  Description of Artificial Sequence: Synthetic oligonucleotide
gaacatattaaggacgtgctgaaatctaat

SEQ ID NO: 1470 - DNA, 30 bp, Artificial Sequence
  Description of Artificial Sequence: Synthetic oligonucleotide
aaagatgaattaatccgtaataatcaagaa

SEQ ID NO: 1471 - DNA, 30 bp, Artificial Sequence
  Description of Artificial Sequence: Synthetic oligonucleotide
ctgaatacccgcttacgtaaactggacgaa

SEQ ID NO: 1472 - DNA, 30 bp, Artificial Sequence
  Description of Artificial Sequence: Synthetic oligonucleotide
aaagataccatcaacaaaattcgtgacctg

SEQ ID NO: 1473 - DNA, 30 bp, Artificial Sequence
  Description of Artificial Sequence: Synthetic oligonucleotide
gaaatgcgtgacttagtgcagcgtgagacc

SEQ ID NO: 1474 - DNA, 30 bp, Artificial Sequence
  Description of Artificial Sequence: Synthetic oligonucleotide
aatcgtgaagttttagaacaggtggagcgt

SEQ ID NO: 1475 - DNA, 30 bp, Artificial Sequence
  Description of Artificial Sequence: Synthetic oligonucleotide
aatcgtgaagttttagatcaggtggagcgt

SEQ ID NO: 1476 - DNA, 30 bp, Artificial Sequence
  Description of Artificial Sequence: Synthetic oligonucleotide
agcgataaagcccacaaagtgctgaagcag

SEQ ID NO: 1477 - DNA, 30 bp, Artificial Sequence
  Description of Artificial Sequence: Synthetic oligonucleotide
gaagcgcagacgcgcgaactgcgtttaaaa

SEQ ID NO: 1478 - DNA, 30 bp, Artificial Sequence
  Description of Artificial Sequence: Synthetic oligonucleotide
ccggaaaccttaaaggaaaatctggacaaa

SEQ ID NO: 1479 - DNA, 30 bp, Artificial Sequence
  Description of Artificial Sequence: Synthetic oligonucleotide
gaaaccaccgccgagcgtattaaaaaggaa

SEQ ID NO: 1480 - DNA, 30 bp, Artificial Sequence
  Description of Artificial Sequence: Synthetic oligonucleotide
ctggatgatttaaagacccgtgtggagagc

SEQ ID NO: 1481 - DNA, 30 bp, Artificial Sequence
  Description of Artificial Sequence: Synthetic oligonucleotide
aaagaacatttaaacgaaattcgtaagaat

SEQ ID NO: 1482 - DNA, 30 bp, Artificial Sequence
  Description of Artificial Sequence: Synthetic oligonucleotide
ggccaggaattagagcgtcagctgaaggaa

SEQ ID NO: 1483 - DNA, 30 bp, Artificial Sequence
  Description of Artificial Sequence: Synthetic oligonucleotide
gataaagtgatccaacagattaaaaaggat

SEQ ID NO: 1484 - DNA, 30 bp, Artificial Sequence
  Description of Artificial Sequence: Synthetic oligonucleotide
cgtgatgaacgcaagaaaagcctgttaagc

SEQ ID NO: 1485 - DNA, 30 bp, Artificial Sequence
  Description of Artificial Sequence: Synthetic oligonucleotide
catgaaacccgcgagctgacccgtatgaat

SEQ ID NO: 1486 - DNA, 30 bp, Artificial Sequence
  Description of Artificial Sequence: Synthetic oligonucleotide
cagccgaccatccgcgaaaaagtgcgcgaa

SEQ ID NO: 1487 - DNA, 30 bp, Artificial Sequence
  Description of Artificial Sequence: Synthetic oligonucleotide
gaaaataccgttaagaaactgcgtgaggcg

SEQ ID NO: 1488 - DNA, 33 bp, Artificial Sequence
  Description of Artificial Sequence: Synthetic oligonucleotide
agcctgatgcgtgagaagattcgtaatgagagc

SEQ ID NO: 1489 - DNA, 33 bp, Artificial Sequence
  Description of Artificial Sequence: Synthetic oligonucleotide
gaaccgatgctgaagaactttgaaaaagacacc

SEQ ID NO: 1490 - DNA, 33 bp, Artificial Sequence
  Description of Artificial Sequence: Synthetic oligonucleotide
gaatgggaacaattaaccgtggaattacgcaaa

SEQ ID NO: 1491 - DNA, 33 bp, Artificial Sequence
  Description of Artificial Sequence: Synthetic oligonucleotide
ggccagaaagacttaatggatcgtctgaacgaa

SEQ ID NO: 1492 - DNA, 33 bp, Artificial Sequence
  Description of Artificial Sequence: Synthetic oligonucleotide
accaaaaccttccacgaagcgattcgcgacaaa

SEQ ID NO: 1493 - DNA, 33 bp, Artificial Sequence
  Description of Artificial Sequence: Synthetic oligonucleotide
aaaggcaaaatcacggattttctgtctgagcat

SEQ ID NO: 1494 - DNA, 33 bp, Artificial Sequence
  Description of Artificial Sequence: Synthetic oligonucleotide
cagaaacgtgttgacaaaatttttgaccaaatg

SEQ ID NO: 1495 - DNA, 33 bp, Artificial Sequence
  Description of Artificial Sequence: Synthetic oligonucleotide
attaatcatacgaaggatattctgaagaagttt

SEQ ID NO: 1496 - DNA, 33 bp, Artificial Sequence
  Description of Artificial Sequence: Synthetic oligonucleotide
gatgaacagcgcaagctgctgaaagaggcccag

SEQ ID NO: 1497 - DNA, 33 bp, Artificial Sequence
  Description of Artificial Sequence: Synthetic oligonucleotide
aaaagcattgccgaggatattattaagaagaat

SEQ ID NO: 1498 - DNA, 33 bp, Artificial Sequence
  Description of Artificial Sequence: Synthetic oligonucleotide
gcggaaaaaatcaagcaggaagtggacgccagc

SEQ ID NO: 1499 - DNA, 33 bp, Artificial Sequence
  Description of Artificial Sequence: Synthetic oligonucleotide
tataaagaagacatcaaaattatgaaacaaacc

SEQ ID NO: 1500 - DNA, 33 bp, Artificial Sequence
  Description of Artificial Sequence: Synthetic oligonucleotide
agcgatgatgttcgccatgcggtgcaacgcgtg

SEQ ID NO: 1501 - DNA, 33 bp, Artificial Sequence
  Description of Artificial Sequence: Synthetic oligonucleotide
catagcaaataccgcgaagaagcgatgcaaaat

SEQ ID NO: 1502 - DNA, 33 bp, Artificial Sequence
  Description of Artificial Sequence: Synthetic oligonucleotide
agctatgatacgggtaaagaaattatcaaggaa

SEQ ID NO: 1503 - DNA, 33 bp, Artificial Sequence
  Description of Artificial Sequence: Synthetic oligonucleotide
ctgaataataaggttgatgaactgaagaagagc

SEQ ID NO: 1504 - DNA, 33 bp, Artificial Sequence
  Description of Artificial Sequence: Synthetic oligonucleotide
tgggaagcgttacgcgaaagcattaagacgcat

SEQ ID NO: 1505 - DNA, 33 bp, Artificial Sequence
  Description of Artificial Sequence: Synthetic oligonucleotide
catagcctggttaaggcgaaactgcgcgagacc

SEQ ID NO: 1506 - DNA, 33 bp, Artificial Sequence
  Description of Artificial Sequence: Synthetic oligonucleotide
gaaaatgataaggagcagctgaaagccatcagc

SEQ ID NO: 1507 - DNA, 33 bp, Artificial Sequence
  Description of Artificial Sequence: Synthetic oligonucleotide
agcattggcgaccgcatgaaacgttatgagaat

SEQ ID NO: 1508 - DNA, 33 bp, Artificial Sequence
  Description of Artificial Sequence: Synthetic oligonucleotide
cgtgataaagttaacgatattgtggaccaagtg

SEQ ID NO: 1509 - DNA, 33 bp, Artificial Sequence
  Description of Artificial Sequence: Synthetic oligonucleotide
gataccgtgtacaagaaactggtgcaacgcgaa

SEQ ID NO: 1510 - DNA, 33 bp, Artificial Sequence
  Description of Artificial Sequence: Synthetic oligonucleotide
agcgaaaaagttgttcaggaagcgttagacaaa

SEQ ID NO: 1511 - DNA, 33 bp, Artificial Sequence
  Description of Artificial Sequence: Synthetic oligonucleotide
gaaaaaaccttatctgcggtgaaagagaagatt

SEQ ID NO: 1512 - DNA, 33 bp, Artificial Sequence
  Description of Artificial Sequence: Synthetic oligonucleotide
cgtgatcagttagttggcaaaattcaagagcgt

SEQ ID NO: 1513 - DNA, 33 bp, Artificial Sequence
  Description of Artificial Sequence: Synthetic oligonucleotide
catgatgaacaaacggcgattaaaaacaagctg

SEQ ID NO: 1514 - DNA, 33 bp, Artificial Sequence
  Description of Artificial Sequence: Synthetic oligonucleotide
ccgaatgatttaaagcatgtgaaaaagttaagc

SEQ ID NO: 1515 - DNA, 33 bp, Artificial Sequence
  Description of Artificial Sequence: Synthetic oligonucleotide
gatgatcgtttaaacaaagtgatttctgagctg

SEQ ID NO: 1516 - DNA, 33 bp, Artificial Sequence
  Description of Artificial Sequence: Synthetic oligonucleotide
aaaaaactgttaacgtggcgtgaagaaacgggc

SEQ ID NO: 1517 - DNA, 33 bp, Artificial Sequence
  Description of Artificial Sequence: Synthetic oligonucleotide
gtgagcgaaaaggagcatgcgacccgcttactg

SEQ ID NO: 1518 - DNA, 33 bp, Artificial Sequence
  Description of Artificial Sequence: Synthetic oligonucleotide
accaatcgtgactacctggcggaacgcttacgt

SEQ ID NO: 1519 - DNA, 33 bp, Artificial Sequence
  Description of Artificial Sequence: Synthetic oligonucleotide
attcatcgttacgttaatgaaatgaataaggaa

SEQ ID NO: 1520 - DNA, 33 bp, Artificial Sequence
  Description of Artificial Sequence: Synthetic oligonucleotide
aatgatcgtaagtcttttctgctgcgcgacagc

SEQ ID NO: 1521 - DNA, 33 bp, Artificial Sequence
  Description of Artificial Sequence: Synthetic oligonucleotide
ctggatgcggcccgcgaaaatgcgcgcaagaat

SEQ ID NO: 1522 - DNA, 33 bp, Artificial Sequence
  Description of Artificial Sequence: Synthetic oligonucleotide
gaaaaaattcaaaaggaagcgcaggaggccctg

SEQ ID NO: 1523 - DNA, 33 bp, Artificial Sequence
  Description of Artificial Sequence: Synthetic oligonucleotide
gatattgcgcgcaaggaacagctgaagtctctg

SEQ ID NO: 1524 - DNA, 33 bp, Artificial Sequence
  Description of Artificial Sequence: Synthetic oligonucleotide
tggagccatacggagcgtctgctgaaggagcat

SEQ ID NO: 1525 - DNA, 33 bp, Artificial Sequence
  Description of Artificial Sequence: Synthetic oligonucleotide
aaagatagcgccgcccgtgcgaaatctgacctg

SEQ ID NO: 1526 - DNA, 33 bp, Artificial Sequence
  Description of Artificial Sequence: Synthetic oligonucleotide
aaagaaaccgagaacaaaattattaaggactat

SEQ ID NO: 1527 - DNA, 33 bp, Artificial Sequence
  Description of Artificial Sequence: Synthetic oligonucleotide
aaagataccttacgcgaaaccattaagttcatg

SEQ ID NO: 1528 - DNA, 33 bp, Artificial Sequence
  Description of Artificial Sequence: Synthetic oligonucleotide
tttaataccatcttaaaagaaattaaggagcgt

SEQ ID NO: 1529 - DNA, 33 bp, Artificial Sequence
  Description of Artificial Sequence: Synthetic oligonucleotide
agcgcgcaggttgaccgtctgcgtgaggagttt

SEQ ID NO: 1530 - DNA, 33 bp, Artificial Sequence
  Description of Artificial Sequence: Synthetic oligonucleotide
aaagcggaaacgaagaaactgattgacttaacc

SEQ ID NO: 1531 - DNA, 33 bp, Artificial Sequence
  Description of Artificial Sequence: Synthetic oligonucleotide
agcaaagaacgcatcccggaaaccgttaagaaa

SEQ ID NO: 1532 - DNA, 33 bp, Artificial Sequence
  Description of Artificial Sequence: Synthetic oligonucleotide
aaacaggaacgcacgctgtttaaagagttaatt

SEQ ID NO: 1533 - DNA, 33 bp, Artificial Sequence
  Description of Artificial Sequence: Synthetic oligonucleotide
gaaaaaagcaagacggcgtttaaagaggcccag

SEQ ID NO: 1534 - DNA, 33 bp, Artificial Sequence
  Description of Artificial Sequence: Synthetic oligonucleotide
ctgagcgaagccttaaaagaagcgacgaaggaa

SEQ ID NO: 1535 - DNA, 33 bp, Artificial Sequence
  Description of Artificial Sequence: Synthetic oligonucleotide
gaaaccaaaatcttcgaagcggtgaagcaagaa

SEQ ID NO: 1536 - DNA, 33 bp, Artificial Sequence
  Description of Artificial Sequence: Synthetic oligonucleotide
gaagaacaggttacgaaactgctgcaccgcaaa

SEQ ID NO: 1537 - DNA, 33 bp, Artificial Sequence
  Description of Artificial Sequence: Synthetic oligonucleotide
cgtaccgatttaaaggattatattacgaagaat

SEQ ID NO: 1538 - DNA, 33 bp, Artificial Sequence
  Description of Artificial Sequence: Synthetic oligonucleotide
accctgctggagaagaccctgaaagagcgcctg

SEQ ID NO: 1539 - DNA, 33 bp, Artificial Sequence
  Description of Artificial Sequence: Synthetic oligonucleotide
aaagaagcgttagccagccgttttaaggagacc

SEQ ID NO: 1540 - DNA, 33 bp, Artificial Sequence
  Description of Artificial Sequence: Synthetic oligonucleotide
gaaaatcagtctaagaaactgaaagagttaatg

SEQ ID NO: 1541 - DNA, 33 bp, Artificial Sequence
  Description of Artificial Sequence: Synthetic oligonucleotide
ctggaaaaagttaagaattggcagaaagacgcg

SEQ ID NO: 1542 - DNA, 33 bp, Artificial Sequence
  Description of Artificial Sequence: Synthetic oligonucleotide
gcgaaaaaacaaatcaatgattatgttgagaaa

SEQ ID NO: 1543 - DNA, 33 bp, Artificial Sequence
  Description of Artificial Sequence: Synthetic oligonucleotide
agcagcctgaaggacattgatattgcccgcgaa

SEQ ID NO: 1544 - DNA, 33 bp, Artificial Sequence
  Description of Artificial Sequence: Synthetic oligonucleotide
gaagaagcgcgcacgcgtaaatttcaagccatg

SEQ ID NO: 1545 - DNA, 33 bp, Artificial Sequence
  Description of Artificial Sequence: Synthetic oligonucleotide
ggcgaagatacgtgggaggcgattaaacaaaaa

SEQ ID NO: 1546 - DNA, 33 bp, Artificial Sequence
  Description of Artificial Sequence: Synthetic oligonucleotide
catcatacccgcgttcgtgtgtatcaagagatt

SEQ ID NO: 1547 - DNA, 33 bp, Artificial Sequence
  Description of Artificial Sequence: Synthetic oligonucleotide
gatgcgcgtaagaaggatctgaaatctatccag

SEQ ID NO: 1548 - DNA, 33 bp, Artificial Sequence
  Description of Artificial Sequence: Synthetic oligonucleotide
gatgaaaaagccgagcatctgcagaagacgtat

SEQ ID NO: 1549 - DNA, 33 bp, Artificial Sequence
  Description of Artificial Sequence: Synthetic oligonucleotide
aaagaatttcaaaaggaaagcctgtctatggat

SEQ ID NO: 1550 - DNA, 33 bp, Artificial Sequence
  Description of Artificial Sequence: Synthetic oligonucleotide
ccgaaagaagccgagcagtttgtgaaggagagc

SEQ ID NO: 1551 - DNA, 33 bp, Artificial Sequence
  Description of Artificial Sequence: Synthetic oligonucleotide
cgtgaagaattcacgaaaaaagtgcgcacgaat

SEQ ID NO: 1552 - DNA, 33 bp, Artificial Sequence
  Description of Artificial Sequence: Synthetic oligonucleotide
gaacgtgcgaacgagctggtggaatcttaccgt

SEQ ID NO: 1553 - DNA, 33 bp, Artificial Sequence
  Description of Artificial Sequence: Synthetic oligonucleotide
gcgagcgatgttgaggaacgtgtgcaaaagagc

SEQ ID NO: 1554 - DNA, 33 bp, Artificial Sequence
  Description of Artificial Sequence: Synthetic oligonucleotide
cgtgaaaatgccttactggaactgtctaagaaa

SEQ ID NO: 1555 - DNA, 33 bp, Artificial Sequence
  Description of Artificial Sequence: Synthetic oligonucleotide
gtggaagaagccaagaatcgtgcggaccaatgg

SEQ ID NO: 1556 - DNA, 33 bp, Artificial Sequence
  Description of Artificial Sequence: Synthetic oligonucleotide
ctggaagaatgggttgagaaagcgaaatctagc

SEQ ID NO: 1557 - DNA, 33 bp, Artificial Sequence
  Description of Artificial Sequence: Synthetic oligonucleotide
atgacccagaaggttgaagaactgaaggagacc

SEQ ID NO: 1558 - DNA, 33 bp, Artificial Sequence
  Description of Artificial Sequence: Synthetic oligonucleotide
gaaaatagcaagaagacccaggaattagttgaa

SEQ ID NO: 1559 - DNA, 33 bp, Artificial Sequence
  Description of Artificial Sequence: Synthetic oligonucleotide
gaaaccaccgccgagcgtattaaaaaggagatt

SEQ ID NO: 1560 - DNA, 33 bp, Artificial Sequence
  Description of Artificial Sequence: Synthetic oligonucleotide
accgatcagatgcgcgaggcggtgaaacgcgtg

SEQ ID NO: 1561 - DNA, 33 bp, Artificial Sequence
  Description of Artificial Sequence: Synthetic oligonucleotide
aatcatgatgttaagctgctgcgtaagttaaat

SEQ ID NO: 1562 - DNA, 33 bp, Artificial Sequence
  Description of Artificial Sequence: Synthetic oligonucleotide
tttgcgaccaagttacgtgaaaaattagagagc

SEQ ID NO: 1563 - DNA, 33 bp, Artificial Sequence
  Description of Artificial Sequence: Synthetic oligonucleotide
gaaaaaggcaagcgcattcgtgaaaactacagc

SEQ ID NO: 1564 - DNA, 33 bp, Artificial Sequence
  Description of Artificial Sequence: Synthetic oligonucleotide
catgatcaggccgttcgtacctatcaagagcat

SEQ ID NO: 1565 - DNA, 33 bp, Artificial Sequence
  Description of Artificial Sequence: Synthetic oligonucleotide
aaagaaaatttattagattttattaagcacaat

SEQ ID NO: 1566 - DNA, 33 bp, Artificial Sequence
  Description of Artificial Sequence: Synthetic oligonucleotide
atggaaagcacgttcgaacgtattaaggagctg

SEQ ID NO: 1567 - DNA, 33 bp, Artificial Sequence
  Description of Artificial Sequence: Synthetic oligonucleotide
aaagatcaggcccgccaggcgctggacaagctg

SEQ ID NO: 1568 - DNA, 33 bp, Artificial Sequence
  Description of Artificial Sequence: Synthetic oligonucleotide
agcaaagatatggagtctcatgtgtttttaaaa

SEQ ID NO: 1569 - DNA, 33 bp, Artificial Sequence
  Description of Artificial Sequence: Synthetic oligonucleotide
gtgaaagatgccatgcaacatctggatcgccag

SEQ ID NO: 1570 - DNA, 33 bp, Artificial Sequence
  Description of Artificial Sequence: Synthetic oligonucleotide
gtggatcgtttaaaggataaagtgaacaacacc

SEQ ID NO: 1571 - DNA, 33 bp, Artificial Sequence
  Description of Artificial Sequence: Synthetic oligonucleotide
aatcgtgatgttgagcgtattgcggagttaagc

SEQ ID NO: 1572 - DNA, 33 bp, Artificial Sequence
  Description of Artificial Sequence: Synthetic oligonucleotide
gatcaggtgtgggacgagattgtgaaaaagaat

SEQ ID NO: 1573 - DNA, 33 bp, Artificial Sequence
  Description of Artificial Sequence: Synthetic oligonucleotide
catgatgcgttaatccagctgcatgagcaacgt

SEQ ID NO: 1574 - DNA, 33 bp, Artificial Sequence
  Description of Artificial Sequence: Synthetic oligonucleotide
aaagaaaaattagaggcgaccattaacgagctg

SEQ ID NO: 1575 - DNA, 33 bp, Artificial Sequence
  Description of Artificial Sequence: Synthetic oligonucleotide
caggcggaattagaccgtctgcgtgttgagacc

SEQ ID NO: 1576 - DNA, 33 bp, Artificial Sequence
  Description of Artificial Sequence: Synthetic oligonucleotide
catgcgatttctacggaaaaaattaaggccaaa

SEQ ID NO: 1577 - DNA, 33 bp, Artificial Sequence
  Description of Artificial Sequence: Synthetic oligonucleotide
caggtgaaagccaagcatctgaaagactctatg

SEQ ID NO: 1578 - DNA, 33 bp, Artificial Sequence
  Description of Artificial Sequence: Synthetic oligonucleotide
catagcaaattagccgaaagcgtggagaaggcg

SEQ ID NO: 1579 - DNA, 33 bp, Artificial Sequence
  Description of Artificial Sequence: Synthetic oligonucleotide
agctatgatcgcttaatgaaaaccattaaggaa

SEQ ID NO: 1580 - DNA, 33 bp, Artificial Sequence
  Description of Artificial Sequence: Synthetic oligonucleotide
gaaaccgatcacttcgatattaaaaacttaaaa

SEQ ID NO: 1581 - DNA, 33 bp, Artificial Sequence
  Description of Artificial Sequence: Synthetic oligonucleotide
aatggcaaagccgccgatcgtattcaccaagat

SEQ ID NO: 1582 - DNA, 33 bp, Artificial Sequence
  Description of Artificial Sequence: Synthetic oligonucleotide
agcgatgatatccgcaaactgctggagtctcag

SEQ ID NO: 1583 - DNA, 33 bp, Artificial Sequence
  Description of Artificial Sequence: Synthetic oligonucleotide
aaaacccagatgcaagagaaagcgaaagagatt

SEQ ID NO: 1584 - DNA, 33 bp, Artificial Sequence
  Description of Artificial Sequence: Synthetic oligonucleotide
gcggataccatcaagaaactgaccgacaagatt

SEQ ID NO: 1585 - DNA, 33 bp, Artificial Sequence
  Description of Artificial Sequence: Synthetic oligonucleotide
ccggataaaacggttaaaaaagtgcaagacaaa

SEQ ID NO: 1586 - DNA, 33 bp, Artificial Sequence
  Description of Artificial Sequence: Synthetic oligonucleotide
accctgaaacaagagtatgaacgtgaccgcgat

SEQ ID NO: 1587 - DNA, 33 bp, Artificial Sequence
  Description of Artificial Sequence: Synthetic oligonucleotide
cgtcagaaagagttagaacagcgtaagttaacc

SEQ ID NO: 1588 - DNA, 33 bp, Artificial Sequence
  Description of Artificial Sequence: Synthetic oligonucleotide
caggcggaattaaaggaactgctgcaaaaggaa

SEQ ID NO: 1589 - DNA, 33 bp, Artificial Sequence
  Description of Artificial Sequence: Synthetic oligonucleotide
agcgataaaatcaagaaatttctgacggagagc

SEQ ID NO: 1590 - DNA, 33 bp, Artificial Sequence
  Description of Artificial Sequence: Synthetic oligonucleotide
aaaagcgatatggagaagctggcgaaagccacc

SEQ ID NO: 1591 - DNA, 33 bp, Artificial Sequence
  Description of Artificial Sequence: Synthetic oligonucleotide
attaaaaaattaaaggaaaatattgcccaacat

SEQ ID NO: 1592 - DNA, 33 bp, Artificial Sequence
  Description of Artificial Sequence: Synthetic oligonucleotide
agcagccatttaaaggcgcatctgcgcacgcat

SEQ ID NO: 1593 - DNA, 33 bp, Artificial Sequence
  Description of Artificial Sequence: Synthetic oligonucleotide
gaactgaaatctaagctgctggatttccgcaat

SEQ ID NO: 1594 - DNA, 33 bp, Artificial Sequence
  Description of Artificial Sequence: Synthetic oligonucleotide
gtggattttttaacggatcagcgtttacgcgaa

SEQ ID NO: 1595 - DNA, 33 bp, Artificial Sequence
  Description of Artificial Sequence: Synthetic oligonucleotide
agcgaacgtggtcgccagctggcggaccacctg

SEQ ID NO: 1596 - DNA, 33 bp, Artificial Sequence
  Description of Artificial Sequence: Synthetic oligonucleotide
cgtattagcgacaagtttaccgaattaaaggaa

SEQ ID NO: 1597 - DNA, 33 bp, Artificial Sequence
  Description of Artificial Sequence: Synthetic oligonucleotide
gatcgtctgatcaagagccatattaagacgaat

SEQ ID NO: 1598 - DNA, 33 bp, Artificial Sequence
  Description of Artificial Sequence: Synthetic oligonucleotide
ctgaaaaattgggttcgcgaactgcgtcaacat

SEQ ID NO: 1599 - DNA, 33 bp, Artificial Sequence
  Description of Artificial Sequence: Synthetic oligonucleotide
aaagcgcatttagcccagcatcagaagacgcat

SEQ ID NO: 1600 - DNA, 33 bp, Artificial Sequence
  Description of Artificial Sequence: Synthetic oligonucleotide
gataaagcggacttagatggccagttaacgaaa

SEQ ID NO: 1601 - DNA, 33 bp, Artificial Sequence
  Description of Artificial Sequence: Synthetic oligonucleotide
accgatgataaggagaaactgctgaagacgctg

SEQ ID NO: 1602 - DNA, 33 bp, Artificial Sequence
  Description of Artificial Sequence: Synthetic oligonucleotide
aaaagcgaattaaaggaactgattaacaacgaa

SEQ ID NO: 1603 - DNA, 33 bp, Artificial Sequence
  Description of Artificial Sequence: Synthetic oligonucleotide
attcatcgttacatccaggaaatgaatcgcaaa

SEQ ID NO: 1604 - DNA, 33 bp, Artificial Sequence
  Description of Artificial Sequence: Synthetic oligonucleotide
ccggaacaggttgagcgtctgaccaaggagttt

SEQ ID NO: 1605 - DNA, 33 bp, Artificial Sequence
  Description of Artificial Sequence: Synthetic oligonucleotide
agcagccatttaaaggcgcatacccgcacgcat

SEQ ID NO: 1606 - DNA, 33 bp, Artificial Sequence
  Description of Artificial Sequence: Synthetic oligonucleotide
gatgaacaggttttagaaaaagtggcccgccag

SEQ ID NO: 1607 - DNA, 33 bp, Artificial Sequence
  Description of Artificial Sequence: Synthetic oligonucleotide
aaaagcgaattaaaggaactgctgacgcgcgaa

SEQ ID NO: 1608 - DNA, 33 bp, Artificial Sequence
  Description of Artificial Sequence: Synthetic oligonucleotide
aaaaatcagaaggacgtgctgaaagagttactg

SEQ ID NO: 1609 - DNA, 33 bp, Artificial Sequence
  Description of Artificial Sequence: Synthetic oligonucleotide
ggcctggaagacaaggtgagcaaacaattagaa

SEQ ID NO: 1610 - DNA, 33 bp, Artificial Sequence
  Description of Artificial Sequence: Synthetic oligonucleotide
gaacgtaaagagatggccaccattctgtctaaa

SEQ ID NO: 1611 - DNA, 33 bp, Artificial Sequence
  Description of Artificial Sequence: Synthetic oligonucleotide
agcgaagatcgcttagtgaatgaaaagttccgt

SEQ ID NO: 1612 - DNA, 33 bp, Artificial Sequence
  Description of Artificial Sequence: Synthetic oligonucleotide
cgtgaacagtacgagaaaatgcagaaagacggc

SEQ ID NO: 1613 - DNA, 33 bp, Artificial Sequence
  Description of Artificial Sequence: Synthetic oligonucleotide
gaaaaaaaattaatcaccgatgcgttaaacaaa

SEQ ID NO: 1614 - DNA, 33 bp, Artificial Sequence
  Description of Artificial Sequence: Synthetic oligonucleotide
aaaaccgaaatcaacgaagcgctgaagaagatt

SEQ ID NO: 1615 - DNA, 33 bp, Artificial Sequence
  Description of Artificial Sequence: Synthetic oligonucleotide
cgtcagctggagtggggtctggaacgtacgcgt

SEQ ID NO: 1616 - DNA, 33 bp, Artificial Sequence
  Description of Artificial Sequence: Synthetic oligonucleotide
accgcgcatcgcttacagctgcatgacgagcat

SEQ ID NO: 1617 - DNA, 33 bp, Artificial Sequence
  Description of Artificial Sequence: Synthetic oligonucleotide
gataaagatttaacgcagctgaaaaaggaggcg

SEQ ID NO: 1618 - DNA, 33 bp, Artificial Sequence
  Description of Artificial Sequence: Synthetic oligonucleotide
gattttcatcacgagacccgtgtgacgttaacc

SEQ ID NO: 1619 - DNA, 33 bp, Artificial Sequence
  Description of Artificial Sequence: Synthetic oligonucleotide
gatgatgcggccaagaaactgcagcgctacacc

SEQ ID NO: 1620 - DNA, 33 bp, Artificial Sequence
  Description of Artificial Sequence: Synthetic oligonucleotide
gcgagcctggttaaggaactgcgtgagcgcacc

SEQ ID NO: 1621 - DNA, 33 bp, Artificial Sequence
  Description of Artificial Sequence: Synthetic oligonucleotide
accaccattcaccgcattaaacagaaggagttt

SEQ ID NO: 1622 - DNA, 33 bp, Artificial Sequence
  Description of Artificial Sequence: Synthetic oligonucleotide
ctgccgcgtgttatgaaggatagcaaaaacgaa

SEQ ID NO: 1623 - DNA, 33 bp, Artificial Sequence
  Description of Artificial Sequence: Synthetic oligonucleotide
gcgcatgatcgcatcctgaaaaccatcaagacc

SEQ ID NO: 1624 - DNA, 33 bp, Artificial Sequence
  Description of Artificial Sequence: Synthetic oligonucleotide
ctggaagatgtttctaattttctgaaggagcgt

SEQ ID NO: 1625 - DNA, 33 bp, Artificial Sequence
  Description of Artificial Sequence: Synthetic oligonucleotide
gaagataaattacgcaccattgcgaacgagaat

SEQ ID NO: 1626 - DNA, 33 bp, Artificial Sequence
  Description of Artificial Sequence: Synthetic oligonucleotide
gtggataaaatccgcaatcagtatcgcgaggat

SEQ ID NO: 1627 - DNA, 33 bp, Artificial Sequence
  Description of Artificial Sequence: Synthetic oligonucleotide
gaaaaagaattatctctgctgcgtaaccgcaaa

SEQ ID NO: 1628 - DNA, 33 bp, Artificial Sequence
  Description of Artificial Sequence: Synthetic oligonucleotide
aatgaaaaataccaaattctggcgcgcgaccat

SEQ ID NO: 1629 - DNA, 33 bp, Artificial Sequence
  Description of Artificial Sequence: Synthetic oligonucleotide
gcgaatgatttattaagcaaagtgaagaaggat

SEQ ID NO: 1630 - DNA, 33 bp, Artificial Sequence
  Description of Artificial Sequence: Synthetic oligonucleotide
catagcattatcaagggcattaaagaccgcacc

SEQ ID NO: 1631 - DNA, 33 bp, Artificial Sequence
  Description of Artificial Sequence: Synthetic oligonucleotide
ccgcgtgaacaattaatggaaagcattcgcaaa

SEQ ID NO: 1632 - DNA, 33 bp, Artificial Sequence
  Description of Artificial Sequence: Synthetic oligonucleotide
gaaacccaggccaaggaactggcggcccacaaa

SEQ ID NO: 1633 - DNA, 33 bp, Artificial Sequence
  Description of Artificial Sequence: Synthetic oligonucleotide
cgtgaaaaattattagataccatgaatcgcctg

SEQ ID NO: 1634 - DNA, 33 bp, Artificial Sequence
  Description of Artificial Sequence: Synthetic oligonucleotide
gatgattttcaacaaaaaattgaaaagatcaaa

SEQ ID NO: 1635 - DNA, 33 bp, Artificial Sequence
  Description of Artificial Sequence: Synthetic oligonucleotide
cgtgtgcatacgtctgaactgaaattacgcgcg

SEQ ID NO: 1636 - DNA, 33 bp, Artificial Sequence
  Description of Artificial Sequence: Synthetic oligonucleotide
gaaaccaaattacgcgaaaccattacgcgccat

SEQ ID NO: 1637 - DNA, 33 bp, Artificial Sequence
  Description of Artificial Sequence: Synthetic oligonucleotide
attagcgatttacaccagaccctgaagaaggaa

SEQ ID NO: 1638 - DNA, 33 bp, Artificial Sequence
  Description of Artificial Sequence: Synthetic oligonucleotide
cagcatgaacgcttaggcaccctggttcgcgaa

SEQ ID NO: 1639 - DNA, 33 bp, Artificial Sequence
  Description of Artificial Sequence: Synthetic oligonucleotide
gatgaatttgacgcccagatgaccaaagccaaa

SEQ ID NO: 1640 - DNA, 33 bp, Artificial Sequence
  Description of Artificial Sequence: Synthetic oligonucleotide
gtgcatgaaaagtggcaaaaagcgattcaaaaa

SEQ ID NO: 1641 - DNA, 33 bp, Artificial Sequence
  Description of Artificial Sequence: Synthetic oligonucleotide
gatgcgaaaatcttaaatgatgtgcaagaccgt

SEQ ID NO: 1642 - DNA, 33 bp, Artificial Sequence
  Description of Artificial Sequence: Synthetic oligonucleotide
aaaagcgatatggacaagctggcgaaagccacc

SEQ ID NO: 1643 - DNA, 33 bp, Artificial Sequence
  Description of Artificial Sequence: Synthetic oligonucleotide
catgtgaaagagacggcgctgaaagagttaaat

SEQ ID NO: 1644 - DNA, 33 bp, Artificial Sequence
  Description of Artificial Sequence: Synthetic oligonucleotide
ctgcgtagccacgacaattttaaagccaagctg

SEQ ID NO: 1645 - DNA, 33 bp, Artificial Sequence
  Description of Artificial Sequence: Synthetic oligonucleotide
gaaattacccgcttagtggaaaccttcaagaaa

SEQ ID NO: 1646 - DNA, 33 bp, Artificial Sequence
  Description of Artificial Sequence: Synthetic oligonucleotide
catagcaccttagagtataaagtgaaggagcgt

SEQ ID NO: 1647 - DNA, 33 bp, Artificial Sequence
  Description of Artificial Sequence: Synthetic oligonucleotide
attcatcagtaccgcgaacagattaagcgcgtg

SEQ ID NO: 1648 - DNA, 33 bp, Artificial Sequence
  Description of Artificial Sequence: Synthetic oligonucleotide
cgtgatctggaccgccagaaacagaagttagaa

SEQ ID NO: 1649 - DNA, 33 bp, Artificial Sequence
  Description of Artificial Sequence: Synthetic oligonucleotide
aaagcggatatcgttcgtcagctgtctgagcgt

SEQ ID NO: 1650 - DNA, 33 bp, Artificial Sequence
  Description of Artificial Sequence: Synthetic oligonucleotide
aaaaaagcgtgggagaacatggtgaccaaagat

SEQ ID NO: 1651 - DNA, 33 bp, Artificial Sequence
  Description of Artificial Sequence: Synthetic oligonucleotide
cataaatttatcgacaccattaccgaccacatg

SEQ ID NO: 1652 - DNA, 33 bp, Artificial Sequence
  Description of Artificial Sequence: Synthetic oligonucleotide
ccgaatgatttaaagcattataaaaagttaagc

SEQ ID NO: 1653 - DNA, 33 bp, Artificial Sequence
  Description of Artificial Sequence: Synthetic oligonucleotide
cgtgatcagggtaaggaaatggcgaccaagtat

SEQ ID NO: 1654 - DNA, 33 bp, Artificial Sequence
  Description of Artificial Sequence: Synthetic oligonucleotide
aaaggcgaattaaagcagctgctgacgaaggaa

SEQ ID NO: 1655 - DNA, 33 bp, Artificial Sequence
  Description of Artificial Sequence: Synthetic oligonucleotide
ccgaatgatttaaagcatctgaaaaagttaagc

SEQ ID NO: 1656 - DNA, 33 bp, Artificial Sequence
  Description of Artificial Sequence: Synthetic oligonucleotide
gaactgaaagaccaactggaaaatttccgccgt

SEQ ID NO: 1657 - DNA, 33 bp, Artificial Sequence
  Description of Artificial Sequence: Synthetic oligonucleotide
gtgcaggatttaacgcgtgaactgaacgagaaa

SEQ ID NO: 1658 - DNA, 33 bp, Artificial Sequence
  Description of Artificial Sequence: Synthetic oligonucleotide
cgtaccagcatcgaccatctgaaagagatcgcg

SEQ ID NO: 1659 - DNA, 33 bp, Artificial Sequence
  Description of Artificial Sequence: Synthetic oligonucleotide
aaagataaacaattagaaaccatggcgcgcctg

SEQ ID NO: 1660 - DNA, 33 bp, Artificial Sequence
  Description of Artificial Sequence: Synthetic oligonucleotide
ctgagccgtgccaaggaatttgcgcaaaagcat

SEQ ID NO: 1661 - DNA, 33 bp, Artificial Sequence
  Description of Artificial Sequence: Synthetic oligonucleotide
ctgaccgatttagttgaacattttaagaagacc

SEQ ID NO: 1662 - DNA, 33 bp, Artificial Sequence
  Description of Artificial Sequence: Synthetic oligonucleotide
tttagcgaaaacttaaaaaaagcgaaggagaaa

SEQ ID NO: 1663 - DNA, 36 bp, Artificial Sequence
  Description of Artificial Sequence: Synthetic oligonucleotide
gataaagatttagaggtgtggaatcgtttaacgagc

SEQ ID NO: 1664 - DNA, 36 bp, Artificial Sequence
  Description of Artificial Sequence: Synthetic oligonucleotide
caggaacgtttagacgcgattgtgtctcgcacccgt

SEQ ID NO: 1665 - DNA, 36 bp, Artificial Sequence
  Description of Artificial Sequence: Synthetic oligonucleotide
gtggatgaagttaagcgtcagattgacttagcgagc

SEQ ID NO: 1666 - DNA, 36 bp, Artificial Sequence
  Description of Artificial Sequence: Synthetic oligonucleotide
cagaccaaaatcgacgcgaaaaaagagcaactggcg

SEQ ID NO: 1667 - DNA, 36 bp, Artificial Sequence
  Description of Artificial Sequence: Synthetic oligonucleotide
gataatgatatccaagatattcgtaaccgcattttt

SEQ ID NO: 1668 - DNA, 36 bp, Artificial Sequence
  Description of Artificial Sequence: Synthetic oligonucleotide
ctgagcgatttcaaggaactgctgcgcacggtgaaa

SEQ ID NO: 1669 - DNA, 36 bp, Artificial Sequence
  Description of Artificial Sequence: Synthetic oligonucleotide
aaagaatgggaaaagaagattagcgaagccatccag

SEQ ID NO: 1670 - DNA, 36 bp, Artificial Sequence
  Description of Artificial Sequence: Synthetic oligonucleotide
ggcgaacgtttcaaggaaaatattcgcaaggtgaat

SEQ ID NO: 1671 - DNA, 36 bp, Artificial Sequence
  Description of Artificial Sequence: Synthetic oligonucleotide
gaacgtgcgcgcacggaatttatttcttctaaactg

SEQ ID NO: 1672 - DNA, 36 bp, Artificial Sequence
  Description of Artificial Sequence: Synthetic oligonucleotide
gatattcatcaataccgtgaacagatcaagcgtgtg

SEQ ID NO: 1673 - DNA, 36 bp, Artificial Sequence
  Description of Artificial Sequence: Synthetic oligonucleotide
ctggataccgactaccagatgaccaaacgcgacatg

SEQ ID NO: 1674 - DNA, 36 bp, Artificial Sequence
  Description of Artificial Sequence: Synthetic oligonucleotide
attgataatgttaagagcaaaattcaagacaaagaa

SEQ ID NO: 1675 - DNA, 36 bp, Artificial Sequence
  Description of Artificial Sequence: Synthetic oligonucleotide
aaagtgctggacgccattattcaggagaagaaaagc

SEQ ID NO: 1676 - DNA, 36 bp, Artificial Sequence
  Description of Artificial Sequence: Synthetic oligonucleotide
aatgcgcaggttaaggatgtggaagagaagtatagc

SEQ ID NO: 1677 - DNA, 36 bp, Artificial Sequence
  Description of Artificial Sequence: Synthetic oligonucleotide
catagccagttcatcaaactggtggccgagaaacgt

SEQ ID NO: 1678 - DNA, 36 bp, Artificial Sequence
  Description of Artificial Sequence: Synthetic oligonucleotide
aaagatgtgttagacgaactgaaaaactacattagc

SEQ ID NO: 1679 - DNA, 36 bp, Artificial Sequence
  Description of Artificial Sequence: Synthetic oligonucleotide
aaaaaaaccatcgccgcggaagatgttttaaatgat

SEQ ID NO: 1680 - DNA, 36 bp, Artificial Sequence
  Description of Artificial Sequence: Synthetic oligonucleotide
gaagaagcgaagatcattaaacagtacgttaaaaat

SEQ ID NO: 1681 - DNA, 36 bp, Artificial Sequence
  Description of Artificial Sequence: Synthetic oligonucleotide
gtgaccgcggttaaggatagctttgagcgccatctg

SEQ ID NO: 1682 - DNA, 36 bp, Artificial Sequence
  Description of Artificial Sequence: Synthetic oligonucleotide
aaaggcacccaaggtgaacgtattgttgaggattat

SEQ ID NO: 1683 - DNA, 36 bp, Artificial Sequence
  Description of Artificial Sequence: Synthetic oligonucleotide
ggcacccatacgaaggaactggatttatggaagagc

SEQ ID NO: 1684 - DNA, 36 bp, Artificial Sequence
  Description of Artificial Sequence: Synthetic oligonucleotide
tatgatgaaatcaaggatgtggtgacgaagctgagc

SEQ ID NO: 1685 - DNA, 36 bp, Artificial Sequence
  Description of Artificial Sequence: Synthetic oligonucleotide
caggaatatgttcgcgaaaccattgacaagctgatg

SEQ ID NO: 1686 - DNA, 36 bp, Artificial Sequence
  Description of Artificial Sequence: Synthetic oligonucleotide
aaagatcatttagacctgctgagcaagtctgcgtat

SEQ ID NO: 1687 - DNA, 36 bp, Artificial Sequence
  Description of Artificial Sequence: Synthetic oligonucleotide
aaagaaagcatcaagaaagcgctggagttaaccatg

SEQ ID NO: 1688 - DNA, 36 bp, Artificial Sequence
  Description of Artificial Sequence: Synthetic oligonucleotide
gatggcctggaggttgcgaaaaccatccgcaaaacc

SEQ ID NO: 1689 - DNA, 36 bp, Artificial Sequence
  Description of Artificial Sequence: Synthetic oligonucleotide
catgatagcatcaagatgtttattaaaaacgccaaa

SEQ ID NO: 1690 - DNA, 36 bp, Artificial Sequence
  Description of Artificial Sequence: Synthetic oligonucleotide
tttaaaaatatcgacgatctgaataaggttctgaaa

SEQ ID NO: 1691 - DNA, 36 bp, Artificial Sequence
  Description of Artificial Sequence: Synthetic oligonucleotide
ccgcaggatatccaagcgtttcgtgagttagataaa

SEQ ID NO: 1692 - DNA, 36 bp, Artificial Sequence
  Description of Artificial Sequence: Synthetic oligonucleotide
ctgaaagaaaaggagaataatgattcttctgataaa

SEQ ID NO: 1693 - DNA, 36 bp, Artificial Sequence
  Description of Artificial Sequence: Synthetic oligonucleotide
cgtgataaagttaacgatattgtggaccaagtgatt

SEQ ID NO: 1694 - DNA, 36 bp, Artificial Sequence
  Description of Artificial Sequence: Synthetic oligonucleotide
cgtaaacagttcgagaaaaccatggaaacgtctagc

SEQ ID NO: 1695 - DNA, 36 bp, Artificial Sequence
  Description of Artificial Sequence: Synthetic oligonucleotide
caggataaattagacaaaattattcaacgcacccgt

SEQ ID NO: 1696 - DNA, 36 bp, Artificial Sequence; identical to SEQ ID NO: 1169
  Description of Artificial Sequence: Synthetic oligonucleotide

SEQ ID NO: 1697 - DNA, 36 bp, Artificial Sequence
  Description of Artificial Sequence: Synthetic oligonucleotide
accaaagatttaaagaaactgatttggaacgagatt

SEQ ID NO: 1698 - DNA, 36 bp, Artificial Sequence
  Description of Artificial Sequence: Synthetic oligonucleotide
accaaagaacgcgagcaggtgattgcccacctgggc

SEQ ID NO: 1699 - DNA, 36 bp, Artificial Sequence
  Description of Artificial Sequence: Synthetic oligonucleotide
aatgaagaatgggacttactgattagcggtaagaaa

SEQ ID NO: 1700 - DNA, 36 bp, Artificial Sequence
  Description of Artificial Sequence: Synthetic oligonucleotide
gaaaccaccgagcgcctgctgaaacaagccgtggaa

SEQ ID NO: 1701 - DNA, 36 bp, Artificial Sequence
  Description of Artificial Sequence: Synthetic oligonucleotide
gatagcacccgccaacgtattgtggagttagcgcat

SEQ ID NO: 1702 - DNA, 36 bp, Artificial Sequence
  Description of Artificial Sequence: Synthetic oligonucleotide
gatcgtgatacgttaaaaaatctgggtgaccgtctg

SEQ ID NO: 1703 - DNA, 36 bp, Artificial Sequence
  Description of Artificial Sequence: Synthetic oligonucleotide
ctggcgcatttacgcgcgcatcagcgcacgcatacc

SEQ ID NO: 1704 - DNA, 36 bp, Artificial Sequence
  Description of Artificial Sequence: Synthetic oligonucleotide
ctggcggaagtttctcagcgtcatgccgagaaactg

SEQ ID NO: 1705 - DNA, 36 bp, Artificial Sequence
  Description of Artificial Sequence: Synthetic oligonucleotide
gcggcgagcttcttaacccgtatgaaagagaagcat

SEQ ID NO: 1706 - DNA, 36 bp, Artificial Sequence
  Description of Artificial Sequence: Synthetic oligonucleotide
gcggatcgtgagaagcagattattacgcacctgaat

SEQ ID NO: 1707 - DNA, 36 bp, Artificial Sequence
  Description of Artificial Sequence: Synthetic oligonucleotide
atggaaagcacgttcgaacgtattaaggagctgagc

SEQ ID NO: 1708 - DNA, 36 bp, Artificial Sequence
  Description of Artificial Sequence: Synthetic oligonucleotide
gaactgcagcgcttatttcgtgatgcccacatgacc

SEQ ID NO: 1709 - DNA, 36 bp, Artificial Sequence
  Description of Artificial Sequence: Synthetic oligonucleotide
gaacatcgtgccttacgtaaagtggtttctagcgcg

SEQ ID NO: 1710 - DNA, 36 bp, Artificial Sequence
  Description of Artificial Sequence: Synthetic oligonucleotide
ggcgaacagcgcaagacctttgtggagttaatgcgt

SEQ ID NO: 1711 - DNA, 36 bp, Artificial Sequence
  Description of Artificial Sequence: Synthetic oligonucleotide
agcgaaaaaatccaaaaagaagtggagtctctgatt

SEQ ID NO: 1712 - DNA, 36 bp, Artificial Sequence
  Description of Artificial Sequence: Synthetic oligonucleotide
attagcaaagttcgcgaaatgcagaaatggttagaa

SEQ ID NO: 1713 - DNA, 36 bp, Artificial Sequence
  Description of Artificial Sequence: Synthetic oligonucleotide
acccaggaacgcgaccgtctgattgacgactttcgt

SEQ ID NO: 1714 - DNA, 36 bp, Artificial Sequence
  Description of Artificial Sequence: Synthetic oligonucleotide
gatgcgcagcgccaagcgaccaaagacgccggccgt

SEQ ID NO: 1715 - DNA, 36 bp, Artificial Sequence
  Description of Artificial Sequence: Synthetic oligonucleotide
gaagatcgtatggagttatatcagacccgcttaagc

SEQ ID NO: 1716 - DNA, 36 bp, Artificial Sequence
  Description of Artificial Sequence: Synthetic oligonucleotide
accagcgaattacgcgaagcgatgcgtaagttactg

SEQ ID NO: 1717 - DNA, 36 bp, Artificial Sequence
  Description of Artificial Sequence: Synthetic oligonucleotide
accgtggaagcctacaaaaccattgcccgcgaagaa

SEQ ID NO: 1718 - DNA, 36 bp, Artificial Sequence
  Description of Artificial Sequence: Synthetic oligonucleotide
aaagcgagcttaaactggcatatgaaaaaacacgat

SEQ ID NO: 1719 - DNA, 36 bp, Artificial Sequence
  Description of Artificial Sequence: Synthetic oligonucleotide
gatgatgtgaagtctattgtgcgtttcgttcaggaa

SEQ ID NO: 1720 - DNA, 36 bp, Artificial Sequence
  Description of Artificial Sequence: Synthetic oligonucleotide
ccgaccgtgcgcgagctgaaagaaacgttagaaaat

SEQ ID NO: 1721 - DNA, 36 bp, Artificial Sequence
  Description of Artificial Sequence: Synthetic oligonucleotide
gaaaatgtgacggagctgaaaaaaaacttcaatcgt

SEQ ID NO: 1722 - DNA, 36 bp, Artificial Sequence
  Description of Artificial Sequence: Synthetic oligonucleotide
cgtcatgatatcttaagcgcgtttgacacgcgtatt

SEQ ID NO: 1723 - DNA, 36 bp, Artificial Sequence
  Description of Artificial Sequence: Synthetic oligonucleotide
accgatagccgcaacgtggatgattacgttcgtaaa

SEQ ID NO: 1724 - DNA, 36 bp, Artificial Sequence
  Description of Artificial Sequence: Synthetic oligonucleotide
cgtgaaggctacgagaaactgaaacaagagctgaat

SEQ ID NO: 1725 - DNA, 36 bp, Artificial Sequence
  Description of Artificial Sequence: Synthetic oligonucleotide
atttatcagcaagttcgtgatgaattaaagcgtgcg

SEQ ID NO: 1726 - DNA, 36 bp, Artificial Sequence
  Description of Artificial Sequence: Synthetic oligonucleotide
agcgatcatttagccgaacatcagcgcacgcatacc

SEQ ID NO: 1727 - DNA, 36 bp, Artificial Sequence
  Description of Artificial Sequence: Synthetic oligonucleotide
cattggggcgaccgcagcgcggatatggccacgcgt

SEQ ID NO: 1728 - DNA, 36 bp, Artificial Sequence
  Description of Artificial Sequence: Synthetic oligonucleotide
aaaagcggccaattactgcatgaattattaaaagaa

SEQ ID NO: 1729 - DNA, 36 bp, Artificial Sequence
  Description of Artificial Sequence: Synthetic oligonucleotide
gaagcgctgtctaagctgctggaacgcatcaaacag

SEQ ID NO: 1730 - DNA, 36 bp, Artificial Sequence
  Description of Artificial Sequence: Synthetic oligonucleotide
cgtgatctgacggacctgatggcgaaaaacatggaa

SEQ ID NO: 1731 - DNA, 36 bp, Artificial Sequence
  Description of Artificial Sequence: Synthetic oligonucleotide
cgttatgatacgttagtgagcgtgttagagcgtgaa

SEQ ID NO: 1732 - DNA, 36 bp, Artificial Sequence
  Description of Artificial Sequence: Synthetic oligonucleotide
cagaaagaaatcgaccgtctgaatgaggttgcgaaa

SEQ ID NO: 1733 - DNA, 36 bp, Artificial Sequence
  Description of Artificial Sequence: Synthetic oligonucleotide
gaaagcctggttgagaaagtgaaagagttcctgagc

SEQ ID NO: 1734 - DNA, 36 bp, Artificial Sequence
  Description of Artificial Sequence: Synthetic oligonucleotide
aaagaagatgccttaaaactggtgcaattaaaacag

SEQ ID NO: 1735 - DNA, 36 bp, Artificial Sequence
  Description of Artificial Sequence: Synthetic oligonucleotide
gtggaacagttacgcaaagaaggcaacgagctgttt

SEQ ID NO: 1736 - DNA, 36 bp, Artificial Sequence
  Description of Artificial Sequence: Synthetic oligonucleotide
aaaacccagatgcaagagaaagcgaaagagatctat

SEQ ID NO: 1737 - DNA, 36 bp, Artificial Sequence
  Description of Artificial Sequence: Synthetic oligonucleotide
ctgaataccaaggttgaagtgctgcgcgaggtggaa

SEQ ID NO: 1738 - DNA, 36 bp, Artificial Sequence
  Description of Artificial Sequence: Synthetic oligonucleotide
cagctgaaatctgttattaaaaaataccgcgaagaa

SEQ ID NO: 1739 - DNA, 36 bp, Artificial Sequence
  Description of Artificial Sequence: Synthetic oligonucleotide
accagcaaatggatcgacgatgtgcgtacggagcgt

SEQ ID NO: 1740 - DNA, 36 bp, Artificial Sequence
  Description of Artificial Sequence: Synthetic oligonucleotide
aaagatgaaatcgacagcaaactggttaactttatt

SEQ ID NO: 1741 - DNA, 36 bp, Artificial Sequence
  Description of Artificial Sequence: Synthetic oligonucleotide
agcgatatgcgtacggagattattcgtatgatggaa

SEQ ID NO: 1742 - DNA, 36 bp, Artificial Sequence
  Description of Artificial Sequence: Synthetic oligonucleotide
accaccaaatggatcgacgatgtgcgtacggagcgt

SEQ ID NO: 1743 - DNA, 36 bp, Artificial Sequence
  Description of Artificial Sequence: Synthetic oligonucleotide
gaaattcatttagagaatatgctgaaaatcacgcgt

SEQ ID NO: 1744 - DNA, 36 bp, Artificial Sequence
  Description of Artificial Sequence: Synthetic oligonucleotide
cgtctggatttagactttcatcagcgcgttcatacc

SEQ ID NO: 1745 - DNA, 36 bp, Artificial Sequence
  Description of Artificial Sequence: Synthetic oligonucleotide
aaaagccagttaatcattcatgaacgcatccatacc

SEQ ID NO: 1746 - DNA, 36 bp, Artificial Sequence
  Description of Artificial Sequence: Synthetic oligonucleotide
agcgtggaacgctacattgtgagccgcttacgtgat

SEQ ID NO: 1747 - DNA, 36 bp, Artificial Sequence
  Description of Artificial Sequence: Synthetic oligonucleotide
aaacatgatgttgagacctttcgtcaattaattggc

SEQ ID NO: 1748 - DNA, 36 bp, Artificial Sequence
  Description of Artificial Sequence: Synthetic oligonucleotide
tatgaaaaagcccgcaccctgattgagaaggtgagc

SEQ ID NO: 1749 - DNA, 36 bp, Artificial Sequence
  Description of Artificial Sequence: Synthetic oligonucleotide
gaactgagcgaccgcgtgctgcgtgccgccaaacag

SEQ ID NO: 1750 - DNA, 36 bp, Artificial Sequence
  Description of Artificial Sequence: Synthetic oligonucleotide
aaagatcagttaatggagaaatatcgtaagatcacc

SEQ ID NO: 1751 - DNA, 36 bp, Artificial Sequence
  Description of Artificial Sequence: Synthetic oligonucleotide
ccggaacgtgagttaaccgaaacccgcgagaaactg

SEQ ID NO: 1752 - DNA, 36 bp, Artificial Sequence
  Description of Artificial Sequence: Synthetic oligonucleotide
gaactgaaagagttaattcgtaaacaccaaaatgat

SEQ ID NO: 1753 - DNA, 36 bp, Artificial Sequence
  Description of Artificial Sequence: Synthetic oligonucleotide
tttgatgatatcaagaaaattatttctaagcagctg

SEQ ID NO: 1754 - DNA, 36 bp, Artificial Sequence
  Description of Artificial Sequence: Synthetic oligonucleotide
attacccgtgactctgtgattcgtatcgccaaagat

SEQ ID NO: 1755 - DNA, 36 bp, Artificial Sequence
  Description of Artificial Sequence: Synthetic oligonucleotide
tggaaagatgccatcaaagaaatgaaacaaacgatt

SEQ ID NO: 1756 - DNA, 36 bp, Artificial Sequence
  Description of Artificial Sequence: Synthetic oligonucleotide
gaaagcgcggttcgcgtggtggaacgcttaaatcgt

SEQ ID NO: 1757 - DNA, 36 bp, Artificial Sequence
  Description of Artificial Sequence: Synthetic oligonucleotide
gatctgaaagccttaagcagcgcgttacacgaacgt

SEQ ID NO: 1758 - DNA, 36 bp, Artificial Sequence
  Description of Artificial Sequence: Synthetic oligonucleotide
gtggatcgtggtacggaactgctggagcgcagcctg

SEQ ID NO: 1759 - DNA, 36 bp, Artificial Sequence
  Description of Artificial Sequence: Synthetic oligonucleotide
ggcgaaacccaccgccatcgtaaacaaatgttcatg

SEQ ID NO: 1760 - DNA, 36 bp, Artificial Sequence
  Description of Artificial Sequence: Synthetic oligonucleotide
aaagaaaccgagaacaaaattattaaggactataaa

SEQ ID NO: 1761 - DNA, 36 bp, Artificial Sequence
  Description of Artificial Sequence: Synthetic oligonucleotide
aaagataaattattaagctttctggacacgcatctg

SEQ ID NO: 1762 - DNA, 36 bp, Artificial Sequence
  Description of Artificial Sequence: Synthetic oligonucleotide
gaaattgcgaaggagacccaggcgcgcgttctggaa

SEQ ID NO: 1763 - DNA, 36 bp, Artificial Sequence
  Description of Artificial Sequence: Synthetic oligonucleotide
tataccgaacgcgaccgtattcagcgcgagcgtctg

SEQ ID NO: 1764 - DNA, 36 bp, Artificial Sequence
  Description of Artificial Sequence: Synthetic oligonucleotide
gataccgaacgcgcccagctggatgttatgaagctg

SEQ ID NO: 1765 - DNA, 36 bp, Artificial Sequence
  Description of Artificial Sequence: Synthetic oligonucleotide
ctgaccctgttagagaaaaccctgaaggagcgtctg

SEQ ID NO: 1766 - DNA, 36 bp, Artificial Sequence
  Description of Artificial Sequence: Synthetic oligonucleotide
cgtaaaattacggacgatctggtgaagaacgtggaa

SEQ ID NO: 1767 - DNA, 36 bp, Artificial Sequence
  Description of Artificial Sequence: Synthetic oligonucleotide
caggaaaccatcaagcatgtgaaagacttaattgcg

SEQ ID NO: 1768 - DNA, 36 bp, Artificial Sequence
  Description of Artificial Sequence: Synthetic oligonucleotide
accgatgtggaccaaaaagtggatcaagttgcgcgt

SEQ ID NO: 1769 - DNA, 36 bp, Artificial Sequence
  Description of Artificial Sequence: Synthetic oligonucleotide
agcgatattacggacgaacagaaaaaggttcgtgaa

SEQ ID NO: 1770 - DNA, 36 bp, Artificial Sequence
  Description of Artificial Sequence: Synthetic oligonucleotide
gaaaatagccgcgttctggtgaaaaagttagcggaa

SEQ ID NO: 1771 - DNA, 36 bp, Artificial Sequence
  Description of Artificial Sequence: Synthetic oligonucleotide
accgataccgccttaaaagaactggagaaggtgacc

SEQ ID NO: 1772 - DNA, 36 bp, Artificial Sequence
  Description of Artificial Sequence: Synthetic oligonucleotide
cataaatttatcgacaccattaccgaccacatgacc

SEQ ID NO: 1773 - DNA, 36 bp, Artificial Sequence
  Description of Artificial Sequence: Synthetic oligonucleotide
gatgaaaccttagccaaaattaaaaaggcctggaat

SEQ ID NO: 1774 - DNA, 36 bp, Artificial Sequence
  Description of Artificial Sequence: Synthetic oligonucleotide
aaaggcacccaagccgatcgtattgttgagaaatat

SEQ ID NO: 1775 - DNA, 36 bp, Artificial Sequence
  Description of Artificial Sequence: Synthetic oligonucleotide
accggccgtatctacagcgatgtgttacgcaaagaa

SEQ ID NO: 1776 - DNA, 36 bp, Artificial Sequence
  Description of Artificial Sequence: Synthetic oligonucleotide
aatgaagatttcgttcgtctgagcacggaggcgcgt

SEQ ID NO: 1777 - DNA, 36 bp, Artificial Sequence
  Description of Artificial Sequence: Synthetic oligonucleotide
ccgcgttttcaagagctgaaaagcgagacgctgaaa

SEQ ID NO: 1778 - DNA, 36 bp, Artificial Sequence
  Description of Artificial Sequence: Synthetic oligonucleotide
gcgcgtgcgcaagccaaacagctggagcacctgaaa

SEQ ID NO: 1779 - DNA, 36 bp, Artificial Sequence
  Description of Artificial Sequence: Synthetic oligonucleotide
gaagtgagcatcaacgatgcgcgtgttcgcgcgcgt

SEQ ID NO: 1780 - DNA, 36 bp, Artificial Sequence
  Description of Artificial Sequence: Synthetic oligonucleotide
gaatttaaattaacgagcgcgattaagaaggaactg

SEQ ID NO: 1781 - DNA, 36 bp, Artificial Sequence
  Description of Artificial Sequence: Synthetic oligonucleotide
aaagaaacctctgacctgctgcgtaagatcgcggcg

SEQ ID NO: 1782 - DNA, 36 bp, Artificial Sequence
  Description of Artificial Sequence: Synthetic oligonucleotide
gaacatacctctgaccgtaaactgttagccaaagaa

SEQ ID NO: 1783 - DNA, 36 bp, Artificial Sequence
  Description of Artificial Sequence: Synthetic oligonucleotide
aaagataaaacgaagggcgatgcgatcgacctgagc

SEQ ID NO: 1784 - DNA, 36 bp, Artificial Sequence
  Description of Artificial Sequence: Synthetic oligonucleotide
gaaaccgcgacgcgcgatcagctgacgaaggaagcg

SEQ ID NO: 1785 - DNA, 36 bp, Artificial Sequence
  Description of Artificial Sequence: Synthetic oligonucleotide
ccggaagataagacgaccgtgcatcgcaagtggagc

SEQ ID NO: 1786 - DNA, 36 bp, Artificial Sequence
  Description of Artificial Sequence: Synthetic oligonucleotide
atgaatgaaggtgcccgtcatatgcgtgagttcacc

SEQ ID NO: 1787 - DNA, 36 bp, Artificial Sequence
  Description of Artificial Sequence: Synthetic oligonucleotide
cgtgaaaaagacttaagctggattacccaacacgcg

SEQ ID NO: 1788 - DNA, 36 bp, Artificial Sequence
  Description of Artificial Sequence: Synthetic oligonucleotide
gatcaggtgaaggaggaaatgaaaattttagttcag

SEQ ID NO: 1789 - DNA, 36 bp, Artificial Sequence
  Description of Artificial Sequence: Synthetic oligonucleotide
gaagatgatttaacgaaagtgctgaactacaccaaa

SEQ ID NO: 1790 - DNA, 36 bp, Artificial Sequence
  Description of Artificial Sequence: Synthetic oligonucleotide
gaacgtgcgaacgagctggtggaatcttaccgtaaa

SEQ ID NO: 1791 - DNA, 36 bp, Artificial Sequence
  Description of Artificial Sequence: Synthetic oligonucleotide
cgtaccagcatcgaccatctgaaagagatcgcgcgt

SEQ ID NO: 1792 - DNA, 36 bp, Artificial Sequence
  Description of Artificial Sequence: Synthetic oligonucleotide
aaagatgatttagcccgtattattacggccgaaagc

SEQ ID NO: 1793 - DNA, 36 bp, Artificial Sequence
  Description of Artificial Sequence: Synthetic oligonucleotide
agcaaactgttacgcgatagccatgttttacatagc

SEQ ID NO: 1794 - DNA, 36 bp, Artificial Sequence
  Description of Artificial Sequence: Synthetic oligonucleotide
gcgaccgatttaaaggaaaccgcgaagaagctgctg

SEQ ID NO: 1795 - DNA, 36 bp, Artificial Sequence
  Description of Artificial Sequence: Synthetic oligonucleotide
cgtaccacccgcgagctggtgggcgacttactggat

SEQ ID NO: 1796 - DNA, 36 bp, Artificial Sequence
  Description of Artificial Sequence: Synthetic oligonucleotide
aatagcaccatcgacaaacgtgtggagcgcctgatt

SEQ ID NO: 1797 - DNA, 36 bp, Artificial Sequence
  Description of Artificial Sequence: Synthetic oligonucleotide
ccgagcaaataccgcgatgaactgacggccaaactg

SEQ ID NO: 1798 - DNA, 36 bp, Artificial Sequence
  Description of Artificial Sequence: Synthetic oligonucleotide
gaaaaagaatacaaggaactgcgtaacgccattagc

SEQ ID NO: 1799 - DNA, 36 bp, Artificial Sequence
  Description of Artificial Sequence: Synthetic oligonucleotide
gaaaaaaccttacgcgataaactggttttagcgacc

SEQ ID NO: 1800 - DNA, 36 bp, Artificial Sequence
  Description of Artificial Sequence: Synthetic oligonucleotide
ctgtttgatcgcttagatgaacatgcccgccagaat

SEQ ID NO: 1801 - DNA, 36 bp, Artificial Sequence
  Description of Artificial Sequence: Synthetic oligonucleotide
ctggataccgactaccagatgaccaaaaaggacatg

SEQ ID NO: 1802 - DNA, 36 bp, Artificial Sequence
  Description of Artificial Sequence: Synthetic oligonucleotide
cgtaaacatgagcaaatgtttcgtgaagccgttaat

SEQ ID NO: 1803 - DNA, 36 bp, Artificial Sequence
  Description of Artificial Sequence: Synthetic oligonucleotide
aaagaaagcttagaggcgctggatgccgccaaaacc

SEQ ID NO: 1804 - DNA, 36 bp, Artificial Sequence
  Description of Artificial Sequence: Synthetic oligonucleotide
catgatgtgtaccgcgatgaagcgttaaacaatcgt

SEQ ID NO: 1805 - DNA, 36 bp, Artificial Sequence
  Description of Artificial Sequence: Synthetic oligonucleotide
gaaaaagatatcgagaattttatgaaaaacgagaaa

SEQ ID NO: 1806 - DNA, 36 bp, Artificial Sequence
  Description of Artificial Sequence: Synthetic oligonucleotide
gattttaatttacgcacccatgtgcgcatccatacc

SEQ ID NO: 1807 - DNA, 36 bp, Artificial Sequence
  Description of Artificial Sequence: Synthetic oligonucleotide
gcgacccaggttgaggaaaaactgcgcgccgaatat

SEQ ID NO: 1808 - DNA, 36 bp, Artificial Sequence
  Description of Artificial Sequence: Synthetic oligonucleotide
aaagtgacccacttcgaacgtctgcaccacaaaacc

SEQ ID NO: 1809 - DNA, 36 bp, Artificial Sequence
  Description of Artificial Sequence: Synthetic oligonucleotide
aaagaagaattagagctggcgaattggatctctaaa

SEQ ID NO: 1810 - DNA, 36 bp, Artificial Sequence
  Description of Artificial Sequence: Synthetic oligonucleotide
catgatatttaccgcgatgaagcgttaaacaatcgt

SEQ ID NO: 1811 - DNA, 36 bp, Artificial Sequence
  Description of Artificial Sequence: Synthetic oligonucleotide
cgtgatgaattaaacgcgtataaatctaagctgaaa

SEQ ID NO: 1812 - DNA, 36 bp, Artificial Sequence
  Description of Artificial Sequence: Synthetic oligonucleotide
attgaaaatgttaaggcgaaaattcaagacaaactg

SEQ ID NO: 1813 - DNA, 36 bp, Artificial Sequence
  Description of Artificial Sequence: Synthetic oligonucleotide
ccggaagataaggttaaagcggtgacgaagctgaat

SEQ ID NO: 1814 - DNA, 36 bp, Artificial Sequence
  Description of Artificial Sequence: Synthetic oligonucleotide
aaaaccgtggaggagattgatcagaagttaaaaagc

SEQ ID NO: 1815 - DNA, 36 bp, Artificial Sequence
  Description of Artificial Sequence: Synthetic oligonucleotide
aaagatcgtttagttgaaagcgtgcaagacgtgctg

SEQ ID NO: 1816 - DNA, 36 bp, Artificial Sequence
  Description of Artificial Sequence: Synthetic oligonucleotide
aaacaggaacgcacgctgtttaaagagttaattaaa

SEQ ID NO: 1817 - DNA, 36 bp, Artificial Sequence
  Description of Artificial Sequence: Synthetic oligonucleotide
gaaaaagtggtttctgaactgaaacaattagcggaa

SEQ ID NO: 1818 - DNA, 36 bp, Artificial Sequence
  Description of Artificial Sequence: Synthetic oligonucleotide
caggaaaaattagacgcgatggtggaacgcacgcgt

SEQ ID NO: 1819 - DNA, 36 bp, Artificial Sequence
  Description of Artificial Sequence: Synthetic oligonucleotide
atgaaaacccgcttcaaaattcagcacgccaccgaa

SEQ ID NO: 1820 - DNA, 36 bp, Artificial Sequence
  Description of Artificial Sequence: Synthetic oligonucleotide
cagtatattgagggtgaaatgcgtacccgcatccgt

SEQ ID NO: 1821 - DNA, 36 bp, Artificial Sequence
  Description of Artificial Sequence: Synthetic oligonucleotide
agcgtgacccgcgttaaaattgcgttagaggaaaaa

SEQ ID NO: 1822 - DNA, 36 bp, Artificial Sequence
  Description of Artificial Sequence: Synthetic oligonucleotide
atgcgtgatgcctctcagtggattaaacgcatggaa

SEQ ID NO: 1823 - DNA, 36 bp, Artificial Sequence
  Description of Artificial Sequence: Synthetic oligonucleotide
cgtaaagatcgcgacaccgcgcgtcaattacatgaa

SEQ ID NO: 1824 - DNA, 36 bp, Artificial Sequence
  Description of Artificial Sequence: Synthetic oligonucleotide
catgaactgaactctaaaattaaagacttagaaacc

SEQ ID NO: 1825 - DNA, 36 bp, Artificial Sequence
  Description of Artificial Sequence: Synthetic oligonucleotide
gatggcacccgcttactggatagcatccgcgatctg

SEQ ID NO: 1826 - DNA, 36 bp, Artificial Sequence
  Description of Artificial Sequence: Synthetic oligonucleotide
ctgattgatgtttacaaaaaaaccttaaagagcgat

SEQ ID NO: 1827 - DNA, 36 bp, Artificial Sequence
  Description of Artificial Sequence: Synthetic oligonucleotide
aaagaacgtttaaaggaactgattttccaagaaacc

SEQ ID NO: 1828 - DNA, 36 bp, Artificial Sequence
  Description of Artificial Sequence: Synthetic oligonucleotide
agccgtattaacgaggcgcgtaaagaggttgaaatg

SEQ ID NO: 1829 - DNA, 36 bp, Artificial Sequence
  Description of Artificial Sequence: Synthetic oligonucleotide
ccggatgatatcgccgaactgaaaacgcgcctgacc

SEQ ID NO: 1830 - DNA, 36 bp, Artificial Sequence
  Description of Artificial Sequence: Synthetic oligonucleotide
catctggatcaattaaaagaaattatgaaggttacc

SEQ ID NO: 1831 - DNA, 36 bp, Artificial Sequence
  Description of Artificial Sequence: Synthetic oligonucleotide
cgtgaaatggtggaccaaattaatcgtgttgcccgt

SEQ ID NO: 1832 - DNA, 36 bp, Artificial Sequence
  Description of Artificial Sequence: Synthetic oligonucleotide
catagcaaataccgcgaagaagcgatgcaaaaccgt

SEQ ID NO: 1833 - DNA, 36 bp, Artificial Sequence
  Description of Artificial Sequence: Synthetic oligonucleotide
gcggataccatcaagaaactgaccgacaagattaaa

SEQ ID NO: 1834 - DNA, 36 bp, Artificial Sequence
  Description of Artificial Sequence: Synthetic oligonucleotide
aaaattgtggagttagaaaatgaattcttaaaaagc

SEQ ID NO: 1835 - DNA, 36 bp, Artificial Sequence
  Description of Artificial Sequence: Synthetic oligonucleotide
ctggatgatttcaaccgtgaaattgttaagcagctg

SEQ ID NO: 1836 - DNA, 36 bp, Artificial Sequence
  Description of Artificial Sequence: Synthetic oligonucleotide
attagcagctacaaggaaaaactggagaaggaacat

SEQ ID NO: 1837 - DNA, 36 bp, Artificial Sequence
  Description of Artificial Sequence: Synthetic oligonucleotide
ctgcgtaaacaattaagcctggatgttttagataaa

SEQ ID NO: 1838 - DNA, 36 bp, Artificial Sequence
  Description of Artificial Sequence: Synthetic oligonucleotide
cgtgaagaattcacgaaaaaagtgcgcacgaatgcg

SEQ ID NO: 1839 - DNA, 36 bp, Artificial Sequence
  Description of Artificial Sequence: Synthetic oligonucleotide
aaagaagaaaagtctgcgattcgtgactacaccaaa

SEQ ID NO: 1840 - DNA, 36 bp, Artificial Sequence
  Description of Artificial Sequence: Synthetic oligonucleotide
ctggataaagttttaagcaaactgtctgagaaatat

SEQ ID NO: 1841 - DNA, 36 bp, Artificial Sequence
  Description of Artificial Sequence: Synthetic oligonucleotide
gaaaaaaccgccgaggattttaccccaacggtgcgt

SEQ ID NO: 1842 - DNA, 36 bp, Artificial Sequence
  Description of Artificial Sequence: Synthetic oligonucleotide
agcattgataagtctgaactgctgtacaaggtggat

SEQ ID NO: 1843 - DNA, 36 bp, Artificial Sequence
  Description of Artificial Sequence: Synthetic oligonucleotide
aaacgtattatcaaggaaaccgaaaagttagtgagc

SEQ ID NO: 1844 - DNA, 36 bp, Artificial Sequence
  Description of Artificial Sequence: Synthetic oligonucleotide
accgcggaagagttcgcgaatcgtttatctaaagat

SEQ ID NO: 1845 - DNA, 36 bp, Artificial Sequence
  Description of Artificial Sequence: Synthetic oligonucleotide
ctggataatttacgcgataccgtgcgcaagtttctg

SEQ ID NO: 1846 - DNA, 36 bp, Artificial Sequence
  Description of Artificial Sequence: Synthetic oligonucleotide
gaaaaagcgaagaaccgtctgaatacggagctgtat

SEQ ID NO: 1847 - DNA, 36 bp, Artificial Sequence
  Description of Artificial Sequence: Synthetic oligonucleotide
gcgccggaacacacgcgtctgcgtaagttagtgacc

SEQ ID NO: 1848 - DNA, 36 bp, Artificial Sequence
  Description of Artificial Sequence: Synthetic oligonucleotide
cagcatagcgccgagctgattaaacacttaattaaa

SEQ ID NO: 1849 - DNA, 36 bp, Artificial Sequence
  Description of Artificial Sequence: Synthetic oligonucleotide
aaagaacagaagacgcagcgtctgatctctgaactg

SEQ ID NO: 1850 - DNA, 36 bp, Artificial Sequence
  Description of Artificial Sequence: Synthetic oligonucleotide
aaagatcatttcgttaaactggaaacgatcgatagc

SEQ ID NO: 1851 - DNA, 36 bp, Artificial Sequence
  Description of Artificial Sequence: Synthetic oligonucleotide
cgtgaaatgctggcctctattgataccttaaaggat

SEQ ID NO: 1852 - DNA, 36 bp, Artificial Sequence
  Description of Artificial Sequence: Synthetic oligonucleotide
gcggatgaaatcaagaccgcgattgacacggcgcgt

SEQ ID NO: 1853 - DNA, 36 bp, Artificial Sequence
  Description of Artificial Sequence: Synthetic oligonucleotide
ctgagcgaaaaggaggcgctgattaagcaaattaaa

SEQ ID NO: 1854 - DNA, 36 bp, Artificial Sequence
  Description of Artificial Sequence: Synthetic oligonucleotide
aaagatcaggagatcaaaaaactggttgaccagaat

SEQ ID NO: 1855 - DNA, 36 bp, Artificial Sequence
  Description of Artificial Sequence: Synthetic oligonucleotide
gaaaatctgaagcgctatgtggaacgcatggagagc

SEQ ID NO: 1856 - DNA, 36 bp, Artificial Sequence
  Description of Artificial Sequence: Synthetic oligonucleotide
cagagcaccttagacaaactgatgcgtgacttagat

SEQ ID NO: 1857 - DNA, 36 bp, Artificial Sequence
  Description of Artificial Sequence: Synthetic oligonucleotide
gcgaaagatatcgccgatgcggtgcgcaagaccagc

SEQ ID NO: 1858 - DNA, 36 bp, Artificial Sequence
  Description of Artificial Sequence: Synthetic oligonucleotide
gataatgcgttacgcaaaagccatcacgccggcatg

SEQ ID NO: 1859 - DNA, 36 bp, Artificial Sequence
  Description of Artificial Sequence: Synthetic oligonucleotide
gatgaagtgacgaacggcattgtgaaggagcgtctg

SEQ ID NO: 1860 - DNA, 36 bp, Artificial Sequence
  Description of Artificial Sequence: Synthetic oligonucleotide
aaagatattacgcaaaaatatcgtacgatcctggat

SEQ ID NO: 1861 - DNA, 36 bp, Artificial Sequence
  Description of Artificial Sequence: Synthetic oligonucleotide
attgaaaatgttaaggcgaaaattcaagacaaaatt

SEQ ID NO: 1862 - DNA, 36 bp, Artificial Sequence
  Description of Artificial Sequence: Synthetic oligonucleotide
aaagataccgttgagaaagtgcgtcaaacgtttgaa

SEQ ID NO: 1863 - DNA, 36 bp, Artificial Sequence
  Description of Artificial Sequence: Synthetic oligonucleotide
gaagatcgtgttaaggaagtggtgacgaagtatagc

SEQ ID NO: 1864 - DNA, 36 bp, Artificial Sequence
  Description of Artificial Sequence: Synthetic oligonucleotide
cagatggaacgcgttcgtaccctgacggacgtgcgt

SEQ ID NO: 1865 - DNA, 36 bp, Artificial Sequence
  Description of Artificial Sequence: Synthetic oligonucleotide
ctgaaagaacgctaccagaaaattggtgacaccaaa

SEQ ID NO: 1866 - DNA, 36 bp, Artificial Sequence
  Description of Artificial Sequence: Synthetic oligonucleotide
agcaaagaaaacatgtctctgctgaaacacttaaaa

SEQ ID NO: 1867 - DNA, 36 bp, Artificial Sequence
  Description of Artificial Sequence: Synthetic oligonucleotide
aaaggcacccaagccgaacgtattgttgagaaatat

SEQ ID NO: 1868 - DNA, 36 bp, Artificial Sequence
  Description of Artificial Sequence: Synthetic oligonucleotide
aaaggcacccaaggtgaaaaaattgttgaggattat

SEQ ID NO: 1869 - DNA, 36 bp, Artificial Sequence
  Description of Artificial Sequence: Synthetic oligonucleotide
cgtaaagaatctcacctggaaaaacaaaagattgat

SEQ ID NO: 1870 - DNA, 36 bp, Artificial Sequence
  Description of Artificial Sequence: Synthetic oligonucleotide
gcgagcgcggacgccgaacgtctgcaccgcagcatg

SEQ ID NO: 1871 - DNA, 36 bp, Artificial Sequence
  Description of Artificial Sequence: Synthetic oligonucleotide
aaaattggcaaggagcatattaatcgcatcaccaat

SEQ ID NO: 1872 - DNA, 36 bp, Artificial Sequence
  Description of Artificial Sequence: Synthetic oligonucleotide
aaagaaagcttattacgtgaagtgcaattactgaaa

SEQ ID NO: 1873 - DNA, 36 bp, Artificial Sequence
  Description of Artificial Sequence: Synthetic oligonucleotide
cgtgtgcgtaaccaatttctgaaagagatggacggc

SEQ ID NO: 1874 - DNA, 36 bp, Artificial Sequence
  Description of Artificial Sequence: Synthetic oligonucleotide
cgtgcggatatcatgacgaaactgaatgaggacttt

SEQ ID NO: 1875 - DNA, 36 bp, Artificial Sequence
  Description of Artificial Sequence: Synthetic oligonucleotide
agccgtggccgcgacctgctgaccgactggttaaaa

SEQ ID NO: 1876 - DNA, 36 bp, Artificial Sequence
  Description of Artificial Sequence: Synthetic oligonucleotide
ccggatcgtttagcccagattgtggagcgcacccgt

SEQ ID NO: 1877 - DNA, 36 bp, Artificial Sequence
  Description of Artificial Sequence: Synthetic oligonucleotide
agcgataaattacaaaaagaagtggagggtctggtg

SEQ ID NO: 1878 - DNA, 36 bp, Artificial Sequence
  Description of Artificial Sequence: Synthetic oligonucleotide
ccgaaaacccaattactgcattttatccgcgaagaa

SEQ ID NO: 1879 - DNA, 36 bp, Artificial Sequence
  Description of Artificial Sequence: Synthetic oligonucleotide
aatgaatatcgccacctgcagcattctatcaaagaa

SEQ ID NO: 1880 - DNA, 36 bp, Artificial Sequence
  Description of Artificial Sequence: Synthetic oligonucleotide
aaatgggtgcaagacagcatggatcatttagacaaa

SEQ ID NO: 1881 - DNA, 36 bp, Artificial Sequence
  Description of Artificial Sequence: Synthetic oligonucleotide
cagtttgaattattagaacgtgcgaaccacaaactg

SEQ ID NO: 1882 - DNA, 36 bp, Artificial Sequence
  Description of Artificial Sequence: Synthetic oligonucleotide
gatatgcgtacggaggtgattcgtatgatggagagc

SEQ ID NO: 1883 - DNA, 36 bp, Artificial Sequence
  Description of Artificial Sequence: Synthetic oligonucleotide
aaacagcgtgaggttctgctgaaaacgttatatcat

SEQ ID NO: 1884 - DNA, 36 bp, Artificial Sequence
  Description of Artificial Sequence: Synthetic oligonucleotide
cgtgaaaccatgttagaggtggtggaacgcacggcg

SEQ ID NO: 1885 - DNA, 36 bp, Artificial Sequence
  Description of Artificial Sequence: Synthetic oligonucleotide
gaaaatgaagccttcaaaattgatacgcgcattggc

SEQ ID NO: 1886 - DNA, 36 bp, Artificial Sequence
  Description of Artificial Sequence: Synthetic oligonucleotide
gcggaaaccatcgacaaactggtggagcgcacccgt

SEQ ID NO: 1887 - DNA, 36 bp, Artificial Sequence
  Description of Artificial Sequence: Synthetic oligonucleotide
aaagtggatatggcccgcgaaattagcaagcaactg

SEQ ID NO: 1888 - DNA, 36 bp, Artificial Sequence
  Description of Artificial Sequence: Synthetic oligonucleotide
cagcgtgatcgcgaggaagcgctgcaccaatttcgt

SEQ ID NO: 1889 - DNA, 36 bp, Artificial Sequence
  Description of Artificial Sequence: Synthetic oligonucleotide
tatgatgaaatggttgagaccatgcgtaaaatcagc

SEQ ID NO: 1890 - DNA, 36 bp, Artificial Sequence
  Description of Artificial Sequence: Synthetic oligonucleotide
aaaagcgaaaaggaggcgattgtgtcttacaccaaa

SEQ ID NO: 1891 - DNA, 36 bp, Artificial Sequence
  Description of Artificial Sequence: Synthetic oligonucleotide
gatgcgaaagcccgcgatgtggtgaaccgcctgacc

SEQ ID NO: 1892 - DNA, 36 bp, Artificial Sequence
  Description of Artificial Sequence: Synthetic oligonucleotide
gatgatgtgcaaaaggtgtttcaggttgccaaagaa

SEQ ID NO: 1893 - DNA, 36 bp, Artificial Sequence
  Description of Artificial Sequence: Synthetic oligonucleotide
aaaaaacaggacgacaatctggaacacttcattagc

SEQ ID NO: 1894 - DNA, 36 bp, Artificial Sequence
  Description of Artificial Sequence: Synthetic oligonucleotide
aatgtgaccttccgcaaagaactggagaagattctg

SEQ ID NO: 1895 - DNA, 36 bp, Artificial Sequence
  Description of Artificial Sequence: Synthetic oligonucleotide
attcagggcaaggttgatgaagtgttccgcaaacag

SEQ ID NO: 1896 - DNA, 36 bp, Artificial Sequence
  Description of Artificial Sequence: Synthetic oligonucleotide
gaagataaagccgttgaactgtattctcgcaccgcg

SEQ ID NO: 1897 - DNA, 36 bp, Artificial Sequence
  Description of Artificial Sequence: Synthetic oligonucleotide
gatgaacagcgcaagctgctgaaagaggcccaggcg

SEQ ID NO: 1898 - DNA, 36 bp, Artificial Sequence
  Description of Artificial Sequence: Synthetic oligonucleotide
ccgaccattatcaaggatcatctgaagaaggcgaat

SEQ ID NO: 1899 - DNA, 36 bp, Artificial Sequence
  Description of Artificial Sequence: Synthetic oligonucleotide
gaactgaaaaagttagaactgctgcgccaaaatgcg

SEQ ID NO: 1900 - DNA, 36 bp, Artificial Sequence
  Description of Artificial Sequence: Synthetic oligonucleotide
gaaaccattaagttactggaaaaaatcttagaaagc

SEQ ID NO: 1901 - DNA, 36 bp, Artificial Sequence
  Description of Artificial Sequence: Synthetic oligonucleotide
accgataatgttgttgaaaaactgcgcaagaaatat

SEQ ID NO: 1902 - DNA, 36 bp, Artificial Sequence
  Description of Artificial Sequence: Synthetic oligonucleotide
gtggatgaagccttaaaagatgcgcaaacgcgtatt

SEQ ID NO: 1903 - DNA, 36 bp, Artificial Sequence
  Description of Artificial Sequence: Synthetic oligonucleotide
aaagtgtttgagacgctggaagcgcgcatgacggaa

SEQ ID NO: 1904 - DNA, 36 bp, Artificial Sequence
  Description of Artificial Sequence: Synthetic oligonucleotide
gcgcgtgatgttttagataatctgttcgagaaaacc

SEQ ID NO: 1905 - DNA, 36 bp, Artificial Sequence
  Description of Artificial Sequence: Synthetic oligonucleotide
ccggtgctggaccgcgtgctggaaaacaaccatcgt

SEQ ID NO: 1906 - DNA, 36 bp, Artificial Sequence
  Description of Artificial Sequence: Synthetic oligonucleotide
gattttagcaaccaactgcgtgcggagttagaaaaa

SEQ ID NO: 1907 - DNA, 36 bp, Artificial Sequence
  Description of Artificial Sequence: Synthetic oligonucleotide
gataaagaacgctctattattagcgacatctttagc

SEQ ID NO: 1908 - DNA, 36 bp, Artificial Sequence
  Description of Artificial Sequence: Synthetic oligonucleotide
gaagaacatacgtacctgcatgcgcaacgccagaaa

SEQ ID NO: 1909 - DNA, 36 bp, Artificial Sequence
  Description of Artificial Sequence: Synthetic oligonucleotide
cgtgatctgcgcaaggcgatgcagcagacgttagaa

SEQ ID NO: 1910 - DNA, 36 bp, Artificial Sequence
  Description of Artificial Sequence: Synthetic oligonucleotide
aaaagcgaattagacgcgtataccaagaagctggtg

SEQ ID NO: 1911 - DNA, 36 bp, Artificial Sequence
  Description of Artificial Sequence: Synthetic oligonucleotide
gaaaaagatcgcaacgatctgattacgtacctgaaa

SEQ ID NO: 1912 - DNA, 36 bp, Artificial Sequence
  Description of Artificial Sequence: Synthetic oligonucleotide
acccgtaaattatctgaaaccgtgttagaggatgtg

SEQ ID NO: 1913 - DNA, 36 bp, Artificial Sequence
  Description of Artificial Sequence: Synthetic oligonucleotide
gatgaaatggtggagacgatgcgtaaaatttctggc

SEQ ID NO: 1914 - DNA, 36 bp, Artificial Sequence
  Description of Artificial Sequence: Synthetic oligonucleotide
agcgataaaatcaagaaatttctgacggagagccat

SEQ ID NO: 1915 - DNA, 36 bp, Artificial Sequence
  Description of Artificial Sequence: Synthetic oligonucleotide
aaagaaaccaaggccctggcggatttcatccgtaat

SEQ ID NO: 1916 - DNA, 36 bp, Artificial Sequence
  Description of Artificial Sequence: Synthetic oligonucleotide
ctgagcgaattagagaattttaaaaaggagctggcg

SEQ ID NO: 1917 - DNA, 36 bp, Artificial Sequence
  Description of Artificial Sequence: Synthetic oligonucleotide
cgtgtggaaaagacgctggaactgatcaagcaggcg

SEQ ID NO: 1918 - DNA, 36 bp, Artificial Sequence
  Description of Artificial Sequence: Synthetic oligonucleotide
catgaacagaagacgcgttatctgccacgcgtggcg

SEQ ID NO: 1919 - DNA, 36 bp, Artificial Sequence
  Description of Artificial Sequence: Synthetic oligonucleotide
aaagatgtgtacgagaaaaccgaatctatcatgggc

SEQ ID NO: 1920 - DNA, 36 bp, Artificial Sequence
  Description of Artificial Sequence: Synthetic oligonucleotide
tatagccatcgcgccgcgcagcgtgagcgcctggcg

SEQ ID NO: 1921 - DNA, 36 bp, Artificial Sequence
  Description of Artificial Sequence: Synthetic oligonucleotide
agcgatcatttaacgacccatattcgcacgcatacc

SEQ ID NO: 1922 - DNA, 36 bp, Artificial Sequence
  Description of Artificial Sequence: Synthetic oligonucleotide
ccgagcggcacgttcgtgcgtgaaaagatccgtgaa

SEQ ID NO: 1923 - DNA, 36 bp, Artificial Sequence
  Description of Artificial Sequence: Synthetic oligonucleotide
aatgataaacgcgttcatcgtctgttaacggtgctg

SEQ ID NO: 1924 - DNA, 36 bp, Artificial Sequence
  Description of Artificial Sequence: Synthetic oligonucleotide
gcggatgaattatctaatgcgaaaaaggttcgtgcg

SEQ ID NO: 1925 - DNA, 36 bp, Artificial Sequence
  Description of Artificial Sequence: Synthetic oligonucleotide
accgaaaaagcctgggaggtgctgaccaaggcccgt

SEQ ID NO: 1926 - DNA, 36 bp, Artificial Sequence
  Description of Artificial Sequence: Synthetic oligonucleotide
attattgataagttatatgaaaaagtttctaaaaat

SEQ ID NO: 1927 - DNA, 36 bp, Artificial Sequence
  Description of Artificial Sequence: Synthetic oligonucleotide
gaaaaaagcttaacggatgcggtgaagttagcgcat

SEQ ID NO: 1928 - DNA, 36 bp, Artificial Sequence
  Description of Artificial Sequence: Synthetic oligonucleotide
gaagatattgcccgcaaagaacagttaaagagcctg

SEQ ID NO: 1929 - DNA, 36 bp, Artificial Sequence
  Description of Artificial Sequence: Synthetic oligonucleotide
aaaagcgataaggacgcgattgtgaacgcctggaaa

SEQ ID NO: 1930 - DNA, 36 bp, Artificial Sequence
  Description of Artificial Sequence: Synthetic oligonucleotide
gaaaaactgaaccaactgtgggaaaaagcccaacgt

SEQ ID NO: 1931 - DNA, 36 bp, Artificial Sequence
  Description of Artificial Sequence: Synthetic oligonucleotide
ccgctggaattcttacgtgcgaatcaacgcaaacat

SEQ ID NO: 1932 - DNA, 36 bp, Artificial Sequence
  Description of Artificial Sequence: Synthetic oligonucleotide
accgatagcgccgagggcgtgcgtaagttcattcgt

SEQ ID NO: 1933 - DNA, 36 bp, Artificial Sequence
  Description of Artificial Sequence: Synthetic oligonucleotide
gaagcggatatcacggcgattaaacgcttaagcgat

SEQ ID NO: 1934 - DNA, 36 bp, Artificial Sequence
  Description of Artificial Sequence: Synthetic oligonucleotide
caggaagatttagacaaaatttttatcaacgtgcgt

SEQ ID NO: 1935 - DNA, 36 bp, Artificial Sequence
  Description of Artificial Sequence: Synthetic oligonucleotide
agcaatcgtcacaaggaatttgaaaaccaaattcgt

SEQ ID NO: 1936 - DNA, 36 bp, Artificial Sequence
  Description of Artificial Sequence: Synthetic oligonucleotide
cagaaagaattattagaagtgatggatcaattacgt

SEQ ID NO: 1937 - DNA, 36 bp, Artificial Sequence
  Description of Artificial Sequence: Synthetic oligonucleotide
cgtgaagcgttagcccgtctggaaacgttagatacc

SEQ ID NO: 1938 - DNA, 36 bp, Artificial Sequence
  Description of Artificial Sequence: Synthetic oligonucleotide
aaaagcctgttaaagattattaatgactacgaagaa

SEQ ID NO: 1939 - DNA, 36 bp, Artificial Sequence
  Description of Artificial Sequence: Synthetic oligonucleotide
attaatcatgccatccgtcaggcgtacgaggataaa

SEQ ID NO: 1940 - DNA, 36 bp, Artificial Sequence
  Description of Artificial Sequence: Synthetic oligonucleotide
gaaaaagcggagaagattaaaaatttattcaatgaa

SEQ ID NO: 1941 - DNA, 36 bp, Artificial Sequence
  Description of Artificial Sequence: Synthetic oligonucleotide
aaacattttcgcacgcgtgaagtggccatcacccag

SEQ ID NO: 1942 - DNA, 36 bp, Artificial Sequence
  Description of Artificial Sequence: Synthetic oligonucleotide
attagcgcgcgcatcaaagaagaattattaaaaaat

SEQ ID NO: 1943 - DNA, 36 bp, Artificial Sequence
  Description of Artificial Sequence: Synthetic oligonucleotide
agcagcctgaaggacattgatattgcccgcgaaaat

SEQ ID NO: 1944 - DNA, 36 bp, Artificial Sequence
  Description of Artificial Sequence: Synthetic oligonucleotide
accctgaaagttttacgtcatcatcaagagaaactg

SEQ ID NO: 1945 - DNA, 36 bp, Artificial Sequence
  Description of Artificial Sequence: Synthetic oligonucleotide
aaagaagatatcgcccgtaaagaacaattaaaaagc

SEQ ID NO: 1946 - DNA, 36 bp, Artificial Sequence
  Description of Artificial Sequence: Synthetic oligonucleotide
accctggtgaaggttaaagatgcggaggaccagctg

SEQ ID NO: 1947 - DNA, 39 bp, Artificial Sequence
  Description of Artificial Sequence: Synthetic oligonucleotide
ggcgatctgatccgcgcgattcaggagacgcatgatcgt

SEQ ID NO: 1948 - DNA, 39 bp, Artificial Sequence
  Description of Artificial Sequence: Synthetic oligonucleotide
ctggataatatgcgcgaggtggtggaacgcaaccgtgcg

SEQ ID NO: 1949 - DNA, 39 bp, Artificial Sequence
  Description of Artificial Sequence: Synthetic oligonucleotide
ccgcatcaggagaagctgctgaaaatcttagcgaaaacc

SEQ ID NO: 1950 - DNA, 39 bp, Artificial Sequence
  Description of Artificial Sequence: Synthetic oligonucleotide
aaaattacccaagacgcggcggaagccatcaaaaaatat

SEQ ID NO: 1951 - DNA, 39 bp, Artificial Sequence
  Description of Artificial Sequence: Synthetic oligonucleotide
ctggaaaaaacgcacgaactgaaagaggttctgaataaa

SEQ ID NO: 1952 - DNA, 39 bp, Artificial Sequence
  Description of Artificial Sequence: Synthetic oligonucleotide
gatgcgaccaaggccgcgaatgatgccttactgaaagaa

SEQ ID NO: 1953 - DNA, 39 bp, Artificial Sequence
  Description of Artificial Sequence: Synthetic oligonucleotide
aatggcctggagcaagcgaaaaaattccacgaagcggtg

SEQ ID NO: 1954 - DNA, 39 bp, Artificial Sequence
  Description of Artificial Sequence: Synthetic oligonucleotide
cgtagcgatgttttagatgcggcggttacgcgtaaaatt

SEQ ID NO: 1955 - DNA, 39 bp, Artificial Sequence
  Description of Artificial Sequence: Synthetic oligonucleotide
gtggtggcggactctatgcagcgtcatgcccgcaaatat

SEQ ID NO: 1956 - DNA, 39 bp, Artificial Sequence
  Description of Artificial Sequence: Synthetic oligonucleotide
gaaagcgcggttcgcgtggtggaacgcttaaatcgtcag

SEQ ID NO: 1957 - DNA, 39 bp, Artificial Sequence
  Description of Artificial Sequence: Synthetic oligonucleotide
gatcgtgatacggagaccctggtgcactggatccgtaaa

SEQ ID NO: 1958 - DNA, 39 bp, Artificial Sequence
  Description of Artificial Sequence: Synthetic oligonucleotide
accgtgctggttcaccgtgtgcattcttacctggaacgt

SEQ ID NO: 1959 - DNA, 39 bp, Artificial Sequence
  Description of Artificial Sequence: Synthetic oligonucleotide
gaagaatatttaacgagcctgggccgcaagcatcgtgcg

SEQ ID NO: 1960 - DNA, 39 bp, Artificial Sequence
  Description of Artificial Sequence: Synthetic oligonucleotide
agctatgaattagagcgtgtggtgcgccaactggaaaat

SEQ ID NO: 1961 - DNA, 39 bp, Artificial Sequence
  Description of Artificial Sequence: Synthetic oligonucleotide
gtgaatcatttagttgataatacccgcaagctggaagaa

SEQ ID NO: 1962 - DNA, 39 bp, Artificial Sequence
  Description of Artificial Sequence: Synthetic oligonucleotide
gtggaaaaagccgagaccctgcgtaagtggttaaatgaa

SEQ ID NO: 1963 - DNA, 39 bp, Artificial Sequence
  Description of Artificial Sequence: Synthetic oligonucleotide
caggataaagttgttgaactggtggacatcatgcagaaa

SEQ ID NO: 1964 - DNA, 39 bp, Artificial Sequence
  Description of Artificial Sequence: Synthetic oligonucleotide
agcattcatcgccacaccgtggtgaagttagcgcatacc

SEQ ID NO: 1965 - DNA, 39 bp, Artificial Sequence
  Description of Artificial Sequence: Synthetic oligonucleotide
gtgaccgatgttacgaccaaagcgaagcaactgaaagat

SEQ ID NO: 1966 - DNA, 39 bp, Artificial Sequence
  Description of Artificial Sequence: Synthetic oligonucleotide
gtggatgaagttcgcaaaatttttcgccaactggcgagc

SEQ ID NO: 1967 - DNA, 39 bp, Artificial Sequence
  Description of Artificial Sequence: Synthetic oligonucleotide
gaaaccattacgttaaaaaaactggaggagtggaaaaat

SEQ ID NO: 1968 - DNA, 39 bp, Artificial Sequence
  Description of Artificial Sequence: Synthetic oligonucleotide
ctgcgtaaacaattaagcctggatgttttagataaactg

SEQ ID NO: 1969 - DNA, 39 bp, Artificial Sequence
  Description of Artificial Sequence: Synthetic oligonucleotide
gaacaggcggaccgcattgtgaaattcgccaaagcgaat

SEQ ID NO: 1970 - DNA, 39 bp, Artificial Sequence
  Description of Artificial Sequence: Synthetic oligonucleotide
gcggatgaacgcgccaaaattaatcaaatcatttttgaa

SEQ ID NO: 1971 - DNA, 39 bp, Artificial Sequence
  Description of Artificial Sequence: Synthetic oligonucleotide
cgttatcagaaggagcgtattgaaaacgttgcgcgtgaa

SEQ ID NO: 1972 - DNA, 39 bp, Artificial Sequence
  Description of Artificial Sequence: Synthetic oligonucleotide
aaagatagcgacgacgatctggtgtaccgcagcctgaaa

SEQ ID NO: 1973 - DNA, 39 bp, Artificial Sequence
  Description of Artificial Sequence: Synthetic oligonucleotide
ccggaaagcgttttaaaagtggcgcaccacgcgagcgaa

SEQ ID NO: 1974 - DNA, 39 bp, Artificial Sequence
  Description of Artificial Sequence: Synthetic oligonucleotide
aaacatgaagcccaacgtctggaacaagaggcgcgtggc

SEQ ID NO: 1975 - DNA, 39 bp, Artificial Sequence
  Description of Artificial Sequence: Synthetic oligonucleotide
aaacatctggttgagcagctgattcgcgacctgaaaacc

SEQ ID NO: 1976 - DNA, 39 bp, Artificial Sequence
  Description of Artificial Sequence: Synthetic oligonucleotide
gaaaatagcttaaagaccgcgcagaaggttcataccgaa

SEQ ID NO: 1977 - DNA, 39 bp, Artificial Sequence
  Description of Artificial Sequence: Synthetic oligonucleotide
ccgcgtaataacttaaaacgtattttaaaggaaatggaa

SEQ ID NO: 1978 - DNA, 39 bp, Artificial Sequence
  Description of Artificial Sequence: Synthetic oligonucleotide
gaagatcagatcaacaaactggtggagttagtgaaaagc

SEQ ID NO: 1979 - DNA, 39 bp, Artificial Sequence
  Description of Artificial Sequence: Synthetic oligonucleotide
gcgcaggcggacttactgaatctgaagcgcaaagtggat

SEQ ID NO: 1980 - DNA, 39 bp, Artificial Sequence
  Description of Artificial Sequence: Synthetic oligonucleotide
gatgaacagcgcaagctgctgaaagaggcccaggcggaa

SEQ ID NO: 1981 - DNA, 39 bp, Artificial Sequence
  Description of Artificial Sequence: Synthetic oligonucleotide
atggatattacgatgttcaaagaagatttaaagagccat

SEQ ID NO: 1982 - DNA, 39 bp, Artificial Sequence
  Description of Artificial Sequence: Synthetic oligonucleotide
gatggcaccatcaagaaatggcaggatatcgcccgtaaa

SEQ ID NO: 1983 - DNA, 39 bp, Artificial Sequence
  Description of Artificial Sequence: Synthetic oligonucleotide
gtggatcgtatcaacgatcgtctgcaagccattgatacc

SEQ ID NO: 1984 - DNA, 39 bp, Artificial Sequence
  Description of Artificial Sequence: Synthetic oligonucleotide
aaagatgaagttgagcgtaaaatgaaatctttactgaat

SEQ ID NO: 1985 - DNA, 39 bp, Artificial Sequence
  Description of Artificial Sequence: Synthetic oligonucleotide
gtggaaagcttaaaccgtgcggatcgcgaggcgcaggcg

SEQ ID NO: 1986 - DNA, 39 bp, Artificial Sequence
  Description of Artificial Sequence: Synthetic oligonucleotide
ccgaccgtgcgcgagctgaaagaaacgttagaaaatagc

SEQ ID NO: 1987 - DNA, 39 bp, Artificial Sequence
  Description of Artificial Sequence: Synthetic oligonucleotide
ccgaaagaattattagatcgtgcgacgacgctgctggaa

SEQ ID NO: 1988 - DNA, 39 bp, Artificial Sequence
  Description of Artificial Sequence: Synthetic oligonucleotide
gaagaagcgttatctaaactgctggagcgcattaaacag

SEQ ID NO: 1989 - DNA, 39 bp, Artificial Sequence
  Description of Artificial Sequence: Synthetic oligonucleotide
aaaaccgaattaatccagaaagcgaagttagcggaacag

SEQ ID NO: 1990 - DNA, 39 bp, Artificial Sequence
  Description of Artificial Sequence: Synthetic oligonucleotide
gaaaaactgaaccaactgtgggaaaaagcccaacgtctg

SEQ ID NO: 1991 - DNA, 39 bp, Artificial Sequence
  Description of Artificial Sequence: Synthetic oligonucleotide
accaaaaccatcgccatttatgataagttaaaagaactg

SEQ ID NO: 1992 - DNA, 39 bp, Artificial Sequence
  Description of Artificial Sequence: Synthetic oligonucleotide
ccggattttcgcgacgaactgacccaagccgcgaaaaaa

SEQ ID NO: 1993 - DNA, 39 bp, Artificial Sequence
  Description of Artificial Sequence: Synthetic oligonucleotide
ctggattttaagaaggaactggaacaaaaggtgaaacag

SEQ ID NO: 1994 - DNA, 39 bp, Artificial Sequence
  Description of Artificial Sequence: Synthetic oligonucleotide
gtggaagtgaagtctgtggtggatttcatccagaaacat

SEQ ID NO: 1995 - DNA, 39 bp, Artificial Sequence
  Description of Artificial Sequence: Synthetic oligonucleotide
aatgaaattcgcaagaaaatttatcaaaagattagcgaa

SEQ ID NO: 1996 - DNA, 39 bp, Artificial Sequence
  Description of Artificial Sequence: Synthetic oligonucleotide
attagcaaagttcgccatatgcaggaatggttagagacc

SEQ ID NO: 1997 - DNA, 39 bp, Artificial Sequence
  Description of Artificial Sequence: Synthetic oligonucleotide
gaagatgtgcgcgagaaactgcaggcctctctgaaaaat

SEQ ID NO: 1998 - DNA, 39 bp, Artificial Sequence
  Description of Artificial Sequence: Synthetic oligonucleotide
ccgaaagatcaagagattaaaaaattagttgatcagaat

SEQ ID NO: 1999 - DNA, 39 bp, Artificial Sequence
  Description of Artificial Sequence: Synthetic oligonucleotide
gatgaacataagttactgtttcgtgttttaaccaatctg

SEQ ID NO: 2000 - DNA, 39 bp, Artificial Sequence
  Description of Artificial Sequence: Synthetic oligonucleotide
accaccaaagagttaattaaaaaattagccgaaattaat

SEQ ID NO: 2001 - DNA, 39 bp, Artificial Sequence
  Description of Artificial Sequence: Synthetic oligonucleotide
agcgaagatgttgacattatttttacgcgcctgaaaggc

SEQ ID NO: 2002 - DNA, 39 bp, Artificial Sequence
  Description of Artificial Sequence: Synthetic oligonucleotide
gaagattttgttaaggcgctgagcgacgccaaacagcgt

SEQ ID NO: 2003 - DNA, 39 bp, Artificial Sequence
  Description of Artificial Sequence: Synthetic oligonucleotide
atgaaagaaacgcaagaaatgctggatttcgccgcgaaa

SEQ ID NO: 2004 - DNA, 39 bp, Artificial Sequence
  Description of Artificial Sequence: Synthetic oligonucleotide
catctgacccgcgccgtggatcgtgccttagcgcgtagc

SEQ ID NO: 2005 - DNA, 39 bp, Artificial Sequence
  Description of Artificial Sequence: Synthetic oligonucleotide
gaaaccaccttaaagcgtctgggcgccacgcatctgcgt

SEQ ID NO: 2006 - DNA, 39 bp, Artificial Sequence
  Description of Artificial Sequence: Synthetic oligonucleotide
catagcaaataccgcgaagaagcgatgcaaaaccgtatt

SEQ ID NO: 2007 - DNA, 39 bp, Artificial Sequence
  Description of Artificial Sequence: Synthetic oligonucleotide
gaagcggcgcgccaagatgcgcagcaataccgtaaaacc

SEQ ID NO: 2008 - DNA, 39 bp, Artificial Sequence
  Description of Artificial Sequence: Synthetic oligonucleotide
gataccaccttaaagcgtctgggcgccacgcatctgaaa

SEQ ID NO: 2009 - DNA, 39 bp, Artificial Sequence
  Description of Artificial Sequence: Synthetic oligonucleotide
tatcagaaagagatcgtggataaacacaacgcgctgcgt

SEQ ID NO: 2010 - DNA, 39 bp, Artificial Sequence
  Description of Artificial Sequence: Synthetic oligonucleotide
catacccaggttatcgaactggaacgcaagtttagccat

SEQ ID NO: 2011 - DNA, 39 bp, Artificial Sequence
  Description of Artificial Sequence: Synthetic oligonucleotide
gatgcggaacgcgagcgttttcgtaacttaacccaggaa

SEQ ID NO: 2012 - DNA, 39 bp, Artificial Sequence
  Description of Artificial Sequence: Synthetic oligonucleotide
aaagtgcagttaaaggaactggaacgcgagtatgcgacc

SEQ ID NO: 2013 - DNA, 39 bp, Artificial Sequence
  Description of Artificial Sequence: Synthetic oligonucleotide
ccggaacagaagaaggtgaatcaggttttaaaagaattt

SEQ ID NO: 2014 - DNA, 39 bp, Artificial Sequence
  Description of Artificial Sequence: Synthetic oligonucleotide
gaaaaaattatcaaggaatttattcaaaagaccctgacc

SEQ ID NO: 2015 - DNA, 39 bp, Artificial Sequence
  Description of Artificial Sequence: Synthetic oligonucleotide
cataaaaccatcgaccgttttattgccttaaccaaaacc

SEQ ID NO: 2016 - DNA, 39 bp, Artificial Sequence
  Description of Artificial Sequence: Synthetic oligonucleotide
gcgctgaaagacgaggcgctgaaaacgttcgtggaacag

SEQ ID NO: 2017 - DNA, 39 bp, Artificial Sequence
  Description of Artificial Sequence: Synthetic oligonucleotide
ccgaaactgacggaggcgctgaaagagcaagtggaaaaa

SEQ ID NO: 2018 - DNA, 39 bp, Artificial Sequence
  Description of Artificial Sequence: Synthetic oligonucleotide
aaagcggtggagcaagtgaaaagcgacttcaataaactg

SEQ ID NO: 2019 - DNA, 39 bp, Artificial Sequence
  Description of Artificial Sequence: Synthetic oligonucleotide
gtggaaagcttacgcaaactggtggaccacctgattaat

SEQ ID NO: 2020 - DNA, 39 bp, Artificial Sequence
  Description of Artificial Sequence: Synthetic oligonucleotide
gatcaggattctaaccgtctgagcgacgccctgaccaaa

SEQ ID NO: 2021 - DNA, 39 bp, Artificial Sequence
  Description of Artificial Sequence: Synthetic oligonucleotide
aaagaaatgtataacgagattattcgtgttttaaaaaat

SEQ ID NO: 2022 - DNA, 39 bp, Artificial Sequence
  Description of Artificial Sequence: Synthetic oligonucleotide
gatggcgatttacgcgcgaccattcaagccctgcatcat

SEQ ID NO: 2023 - DNA, 39 bp, Artificial Sequence
  Description of Artificial Sequence: Synthetic oligonucleotide
gtggaaatgaaatctgagtttctggcgacgaaggcgaaa

SEQ ID NO: 2024 - DNA, 39 bp, Artificial Sequence
  Description of Artificial Sequence: Synthetic oligonucleotide
gcggaaaccttaatggaccgtattaaaaagcaactgcgt

SEQ ID NO: 2025 - DNA, 39 bp, Artificial Sequence
  Description of Artificial Sequence: Synthetic oligonucleotide
gcggcgctggagacgcatgcgcaggccttacgtgaacgt

SEQ ID NO: 2026 - DNA, 39 bp, Artificial Sequence
  Description of Artificial Sequence: Synthetic oligonucleotide
cgtgaaaaacgcgttagcaatgcggttgagtttctgctg

SEQ ID NO: 2027 - DNA, 39 bp, Artificial Sequence
  Description of Artificial Sequence: Synthetic oligonucleotide
cgtgaactgacgtctctgctgaaagagttactggaaatg

SEQ ID NO: 2028 - DNA, 39 bp, Artificial Sequence
  Description of Artificial Sequence: Synthetic oligonucleotide
acccatgaagccgttcatctgaccgcccacgcgaaagaa

SEQ ID NO: 2029 - DNA, 39 bp, Artificial Sequence
  Description of Artificial Sequence: Synthetic oligonucleotide
ctggatgaattacaactgtttaccgacgccattcgtaaa

SEQ ID NO: 2030 - DNA, 39 bp, Artificial Sequence
  Description of Artificial Sequence: Synthetic oligonucleotide
cgtgatagcttaggtgcgctgagcaaggccctgaaagaa

SEQ ID NO: 2031 - DNA, 39 bp, Artificial Sequence
  Description of Artificial Sequence: Synthetic oligonucleotide
agcgatgaacgcgccgcggtgtatcgcgccattgaaacc

SEQ ID NO: 2032 - DNA, 39 bp, Artificial Sequence
  Description of Artificial Sequence: Synthetic oligonucleotide
agcaaaggcgcccaagatctggcgcgcgccattaaagat

SEQ ID NO: 2033 - DNA, 39 bp, Artificial Sequence
  Description of Artificial Sequence: Synthetic oligonucleotide
gatgaaattcgcaacgaagcgcatcaattactgaaactg

SEQ ID NO: 2034 - DNA, 39 bp, Artificial Sequence
  Description of Artificial Sequence: Synthetic oligonucleotide
ccgcgtaccaacgagcgtatttttgagttactgctgcgt

SEQ ID NO: 2035 - DNA, 39 bp, Artificial Sequence
  Description of Artificial Sequence: Synthetic oligonucleotide
ctgaaagaagccgttgaactggcgaagttcaccaccgat

SEQ ID NO: 2036 - DNA, 39 bp, Artificial Sequence
  Description of Artificial Sequence: Synthetic oligonucleotide
catagcctgaacgttaaactggtgaaggagctggcgaaa

SEQ ID NO: 2037 - DNA, 39 bp, Artificial Sequence
  Description of Artificial Sequence: Synthetic oligonucleotide
cataaaaatgttatgcgcatggtgaatcatgaggttagc

SEQ ID NO: 2038 - DNA, 39 bp, Artificial Sequence
  Description of Artificial Sequence: Synthetic oligonucleotide
ccggaaaatgccatcaaacgtgcggacgagctgattagc

SEQ ID NO: 2039 - DNA, 39 bp, Artificial Sequence
  Description of Artificial Sequence: Synthetic oligonucleotide
ctgaaacagttcaagaatgatctgaagcacgtgctgcag

SEQ ID NO: 2040 - DNA, 39 bp, Artificial Sequence
  Description of Artificial Sequence: Synthetic oligonucleotide
cagcgtgtgatctctcatgtggaagccgaggcgaaaatt

SEQ ID NO: 2041 - DNA, 39 bp, Artificial Sequence
  Description of Artificial Sequence: Synthetic oligonucleotide
accgataaattacgcggcgaagcgttagacctgcagcat

SEQ ID NO: 2042 - DNA, 39 bp, Artificial Sequence
  Description of Artificial Sequence: Synthetic oligonucleotide
gatcgtgtgaacgaggcggcgcagttcgcccgtagcaaa

SEQ ID NO: 2043 - DNA, 39 bp, Artificial Sequence
  Description of Artificial Sequence: Synthetic oligonucleotide
agctgggaagcccgcgcgctgctgcacacgctggaacat

SEQ ID NO: 2044 - DNA, 39 bp, Artificial Sequence
  Description of Artificial Sequence: Synthetic oligonucleotide
cataccaccgttcgcaatgcgctgaaggacctgctgaaa

SEQ ID NO: 2045 - DNA, 39 bp, Artificial Sequence
  Description of Artificial Sequence: Synthetic oligonucleotide
tgggatgatcaacaaaaagtgaaaaagacggcggaagcg

SEQ ID NO: 2046 - DNA, 39 bp, Artificial Sequence
  Description of Artificial Sequence: Synthetic oligonucleotide
gaaaaagcgtaccgccaggtgaatgagttactgcataat

SEQ ID NO: 2047 - DNA, 39 bp, Artificial Sequence
  Description of Artificial Sequence: Synthetic oligonucleotide
gaagaagataaggttgcggtgaaagccgccgtgcagaat

SEQ ID NO: 2048 - DNA, 39 bp, Artificial Sequence
  Description of Artificial Sequence: Synthetic oligonucleotide
catcataccgcctctgaaagctttatgaagcacatgcag

SEQ ID NO: 2049 - DNA, 39 bp, Artificial Sequence
  Description of Artificial Sequence: Synthetic oligonucleotide
agcgcgcaggttcaaaaagaagaacaattaaaaattgat

SEQ ID NO: 2050 - DNA, 39 bp, Artificial Sequence
  Description of Artificial Sequence: Synthetic oligonucleotide
ctgagcgatacggttcgtgtgaatcgcaagatgcgtgat

SEQ ID NO: 2051 - DNA, 39 bp, Artificial Sequence
  Description of Artificial Sequence: Synthetic oligonucleotide
ctggatgatgcccgcgcgctgaccacgcgcgcgaaagcg

SEQ ID NO: 2052 - DNA, 39 bp, Artificial Sequence
  Description of Artificial Sequence: Synthetic oligonucleotide
gcggtgcagaaggagagcgatgaatacatcctggcgaaa

SEQ ID NO: 2053 - DNA, 39 bp, Artificial Sequence
  Description of Artificial Sequence: Synthetic oligonucleotide
gcggtggaacgcacgcgtgaactgttcgccaaaagcctg

SEQ ID NO: 2054 - DNA, 39 bp, Artificial Sequence
  Description of Artificial Sequence: Synthetic oligonucleotide
gatacccgtaaccgcctgctggcgcaattcgcggataaa

SEQ ID NO: 2055 - DNA, 39 bp, Artificial Sequence
  Description of Artificial Sequence: Synthetic oligonucleotide
gaatttgcgaaggttattgtgcagaagttaaaagataat

SEQ ID NO: 2056 - DNA, 39 bp, Artificial Sequence
  Description of Artificial Sequence: Synthetic oligonucleotide
gaacgttatgttgagcagctgaaacaagccctgaaaacc

SEQ ID NO: 2057 - DNA, 39 bp, Artificial Sequence
  Description of Artificial Sequence: Synthetic oligonucleotide
ctgaaagataagttactgcataaacaattcgcgagccat

SEQ ID NO: 2058 - DNA, 39 bp, Artificial Sequence
  Description of Artificial Sequence: Synthetic oligonucleotide
aaaaaaagctacgacgaaattgcggagaagctgaatgat

SEQ ID NO: 2059 - DNA, 39 bp, Artificial Sequence
  Description of Artificial Sequence: Synthetic oligonucleotide
gataatgaaaagaacgaatttcagttagttctgaataaa

SEQ ID NO: 2060 - DNA, 39 bp, Artificial Sequence
  Description of Artificial Sequence: Synthetic oligonucleotide
caggaagcgatccaagcggcgattaagaaggtggaagat

SEQ ID NO: 2061 - DNA, 39 bp, Artificial Sequence
  Description of Artificial Sequence: Synthetic oligonucleotide
gaaaaactgacgtctcagatttatgaggagaccgtgaaa

SEQ ID NO: 2062 - DNA, 39 bp, Artificial Sequence
  Description of Artificial Sequence: Synthetic oligonucleotide
catgatgtgcacacgctggtgctgggtcgcgaaattacc

SEQ ID NO: 2063 - DNA, 39 bp, Artificial Sequence
  Description of Artificial Sequence: Synthetic oligonucleotide
caggatctgcgcaagaaaattgtggacttacataaaagc

SEQ ID NO: 2064 - DNA, 39 bp, Artificial Sequence
  Description of Artificial Sequence: Synthetic oligonucleotide
gaacatgtgcgcaaggtgtttgatgagatccagcagaaa

SEQ ID NO: 2065 - DNA, 39 bp, Artificial Sequence
  Description of Artificial Sequence: Synthetic oligonucleotide
aaagaacagttagccgaactgaaagtttcttatctgaaa

SEQ ID NO: 2066 - DNA, 39 bp, Artificial Sequence
  Description of Artificial Sequence: Synthetic oligonucleotide
aattggccgaagacgctgaaactggccttagaaaaagaa

SEQ ID NO: 2067 - DNA, 39 bp, Artificial Sequence
  Description of Artificial Sequence: Synthetic oligonucleotide
acccatggctctcgcatggattttattgttaaggaactg

SEQ ID NO: 2068 - DNA, 39 bp, Artificial Sequence
  Description of Artificial Sequence: Synthetic oligonucleotide
ctgaccgaattcacgaatgaaaaagacacgctgagcaaa

SEQ ID NO: 2069 - DNA, 39 bp, Artificial Sequence
  Description of Artificial Sequence: Synthetic oligonucleotide
ctgaattatgttaaggaaaaactggaggaggtgcatagc

SEQ ID NO: 2070 - DNA, 39 bp, Artificial Sequence
  Description of Artificial Sequence: Synthetic oligonucleotide
gtggaaggcgtttggacgctgaaagatgagatcaaaacc

SEQ ID NO: 2071 - DNA, 39 bp, Artificial Sequence
  Description of Artificial Sequence: Synthetic oligonucleotide
aatgaagatgttgcccgtaccaaaaagatcattcagcgt

SEQ ID NO: 2072 - DNA, 39 bp, Artificial Sequence
  Description of Artificial Sequence: Synthetic oligonucleotide
gcggaaaccaagaagctgctggatatcgttgcgcgtagc

SEQ ID NO: 2073 - DNA, 39 bp, Artificial Sequence
  Description of Artificial Sequence: Synthetic oligonucleotide
gattatattttaaagagcctgctggagtctgcggaaaaa

SEQ ID NO: 2074 - DNA, 39 bp, Artificial Sequence
  Description of Artificial Sequence: Synthetic oligonucleotide
gatcgtattggtacgcatatgattaattctgccgaaaaa

SEQ ID NO: 2075 - DNA, 39 bp, Artificial Sequence
  Description of Artificial Sequence: Synthetic oligonucleotide
agcgaagatgttgttgtgagcaaagttggtcgtgatctg

SEQ ID NO: 2076 - DNA, 39 bp, Artificial Sequence
  Description of Artificial Sequence: Synthetic oligonucleotide
catagcgaaacggttgcgaaacatggtgccaaactgagc

SEQ ID NO: 2077 - DNA, 39 bp, Artificial Sequence
  Description of Artificial Sequence: Synthetic oligonucleotide
ctggatagcacgttagaagcggtgcgcaaggcgaaagat

SEQ ID NO: 2078 - DNA, 39 bp, Artificial Sequence
  Description of Artificial Sequence: Synthetic oligonucleotide
gtggaaagcaacttagatgtggtgcgccaaaaactggaa

SEQ ID NO: 2079 - DNA, 39 bp, Artificial Sequence
  Description of Artificial Sequence: Synthetic oligonucleotide
gaacgtaatacggagaaagtgcgtgactacctggaaagc

SEQ ID NO: 2080 - DNA, 39 bp, Artificial Sequence
  Description of Artificial Sequence: Synthetic oligonucleotide
aatgatcgtttaatcgcgaccctgaagtctatgcgtgat

SEQ ID NO: 2081 - DNA, 39 bp, Artificial Sequence
  Description of Artificial Sequence: Synthetic oligonucleotide
aaaagcaccaaccgcgattatctggccgagcgtctgcgt

SEQ ID NO: 2082 - DNA, 39 bp, Artificial Sequence
  Description of Artificial Sequence: Synthetic oligonucleotide
cgtgaagaatggaagggtggcgcggaaacgaacaaaatt

SEQ ID NO: 2083 - DNA, 39 bp, Artificial Sequence
  Description of Artificial Sequence: Synthetic oligonucleotide
agcgcggcgatccaccgtctggtggacacgagcgaaaaa

SEQ ID NO: 2084 - DNA, 39 bp, Artificial Sequence
  Description of Artificial Sequence: Synthetic oligonucleotide
ccgaaagcgggtgacgaatttgtggagaagaccctgagc

SEQ ID NO: 2085 - DNA, 39 bp, Artificial Sequence
  Description of Artificial Sequence: Synthetic oligonucleotide
accccgcgtaagcgcctgaaagaatctttagatcagatt

SEQ ID NO: 2086 - DNA, 39 bp, Artificial Sequence
  Description of Artificial Sequence: Synthetic oligonucleotide
gaacatagcgccaagagcctgcgtttattactggcggaa

SEQ ID NO: 2087 - DNA, 39 bp, Artificial Sequence
  Description of Artificial Sequence: Synthetic oligonucleotide
caggaatttcgcgaggcgattcgtaaggccctgctgacc

SEQ ID NO: 2088 - DNA, 39 bp, Artificial Sequence
  Description of Artificial Sequence: Synthetic oligonucleotide
accaaagatgccgagaaagtggtgtctgagattaaagcg

SEQ ID NO: 2089 - DNA, 39 bp, Artificial Sequence
  Description of Artificial Sequence: Synthetic oligonucleotide
ctggaaggcttaaaggatattacccgcgaggtggcgagc

SEQ ID NO: 2090 - DNA, 39 bp, Artificial Sequence
  Description of Artificial Sequence: Synthetic oligonucleotide
gtgaccgatcgcatcgtgcgtaccttacacgatctgagc

SEQ ID NO: 2091 - DNA, 39 bp, Artificial Sequence
  Description of Artificial Sequence: Synthetic oligonucleotide
gatagcaaattagttgataaaattgccaacgaaattagc

SEQ ID NO: 2092 - DNA, 39 bp, Artificial Sequence
  Description of Artificial Sequence: Synthetic oligonucleotide
gaaggccatttatctctgatgcgtctggcccgccagcat

SEQ ID NO: 2093 - DNA, 39 bp, Artificial Sequence
  Description of Artificial Sequence: Synthetic oligonucleotide
caggaatatgttcgcgaaaccattgacaagctgatggcg

SEQ ID NO: 2094 - DNA, 39 bp, Artificial Sequence
  Description of Artificial Sequence: Synthetic oligonucleotide
ccgacccgtaaggaggaagtggtgcgcgccctgaataat

SEQ ID NO: 2095 - DNA, 39 bp, Artificial Sequence
  Description of Artificial Sequence: Synthetic oligonucleotide
agcgcgattaaggacgaactgattaagacgctggatggc

SEQ ID NO: 2096 - DNA, 39 bp, Artificial Sequence
  Description of Artificial Sequence: Synthetic oligonucleotide
cgtgatgtggacacgaccatggaactgttaaagcgtctg

SEQ ID NO: 2097 - DNA, 39 bp, Artificial Sequence
  Description of Artificial Sequence: Synthetic oligonucleotide
gtggataccacgcgccatgtggatgttttacatgcgtgg

SEQ ID NO: 2098 - DNA, 39 bp, Artificial Sequence
  Description of Artificial Sequence: Synthetic oligonucleotide
gaaaaactgaaggagaccgtggtgaaggccgtgagcatt

SEQ ID NO: 2099 - DNA, 39 bp, Artificial Sequence
  Description of Artificial Sequence: Synthetic oligonucleotide
aaaagccgtttatctcatcagattacgcgcatggaaaat

SEQ ID NO: 2100 - DNA, 39 bp, Artificial Sequence
  Description of Artificial Sequence: Synthetic oligonucleotide
agccgtctggaggacgcggtgaaaaagacggtggcggaa

SEQ ID NO: 2101 - DNA, 39 bp, Artificial Sequence
  Description of Artificial Sequence: Synthetic oligonucleotide
agcgtggatacgttagcgaaactggcccgcgaaaaactg

SEQ ID NO: 2102 - DNA, 39 bp, Artificial Sequence
  Description of Artificial Sequence: Synthetic oligonucleotide
gatgcggataagacgcgttataccgccttaattattaaa

SEQ ID NO: 2103 - DNA, 39 bp, Artificial Sequence
  Description of Artificial Sequence: Synthetic oligonucleotide
ccggaacaggttatcgcggaagcgatccgcaaaaaaacc

SEQ ID NO: 2104 - DNA, 39 bp, Artificial Sequence
  Description of Artificial Sequence: Synthetic oligonucleotide
gaaaccaccttaaagcgtctgggcgcctctcatagcaaa

SEQ ID NO: 2105 - DNA, 39 bp, Artificial Sequence
  Description of Artificial Sequence: Synthetic oligonucleotide
gataccagcaaccgcctgaaacagatcatggccgaacgt

SEQ ID NO: 2106 - DNA, 39 bp, Artificial Sequence
  Description of Artificial Sequence: Synthetic oligonucleotide
accagcgatgttatcaaagatctgatggagcgcattaaa

SEQ ID NO: 2107 - DNA, 39 bp, Artificial Sequence
  Description of Artificial Sequence: Synthetic oligonucleotide
ccgcgtcagttaaaggaaattcaggacttcgtgaaagaa

SEQ ID NO: 2108 - DNA, 39 bp, Artificial Sequence
  Description of Artificial Sequence: Synthetic oligonucleotide
gaaaaagcggcccaaaaagtggtgtctgaggtggaagcg

SEQ ID NO: 2109 - DNA, 39 bp, Artificial Sequence
  Description of Artificial Sequence: Synthetic oligonucleotide
accaccggcgttcaccgtctgtatcaaatggagaaagat

SEQ ID NO: 2110 - DNA, 39 bp, Artificial Sequence
  Description of Artificial Sequence: Synthetic oligonucleotide
gatcgtacccaaacggtgctgcgtgacatccgtgatgcg

SEQ ID NO: 2111 - DNA, 39 bp, Artificial Sequence
  Description of Artificial Sequence: Synthetic oligonucleotide
gatgcgcagaaggagaaatatctgccaaagctggcgacc

SEQ ID NO: 2112 - DNA, 39 bp, Artificial Sequence
  Description of Artificial Sequence: Synthetic oligonucleotide
cagcatggctctcgctttattcagcaaaagctggaacgt

SEQ ID NO: 2113 - DNA, 39 bp, Artificial Sequence
  Description of Artificial Sequence: Synthetic oligonucleotide
gaagcggattacatcgaacgtaccgtttctaaagtgatg

SEQ ID NO: 2114 - DNA, 39 bp, Artificial Sequence
  Description of Artificial Sequence: Synthetic oligonucleotide
ctggataaaatgcaacaatttgtgaccaagttacatcgt

SEQ ID NO: 2115 - DNA, 39 bp, Artificial Sequence
  Description of Artificial Sequence: Synthetic oligonucleotide
gatctgaaaacgatcaaaaaaaccttacaagaactgctg

SEQ ID NO: 2116 - DNA, 39 bp, Artificial Sequence
  Description of Artificial Sequence: Synthetic oligonucleotide
cgtgaaaccgttaacaaagcgctggccgactttgcgcat

SEQ ID NO: 2117 - DNA, 39 bp, Artificial Sequence
  Description of Artificial Sequence: Synthetic oligonucleotide
tgggatcagttattagataatgtggccaagctgaaaaaa

SEQ ID NO: 2118 - DNA, 39 bp, Artificial Sequence
  Description of Artificial Sequence: Synthetic oligonucleotide
gatgtgccggaggccctgaatcgtacgttaaaagatctg

SEQ ID NO: 2119 - DNA, 39 bp, Artificial Sequence
  Description of Artificial Sequence: Synthetic oligonucleotide
gaaaaagtggccgaccgtctgaaattccaactgggccag

SEQ ID NO: 2120 - DNA, 39 bp, Artificial Sequence
  Description of Artificial Sequence: Synthetic oligonucleotide
agcaccgaagttgagctgagcatgaaattacgcgaatat

SEQ ID NO: 2121 - DNA, 39 bp, Artificial Sequence
  Description of Artificial Sequence: Synthetic oligonucleotide
ccggatctgcacttaaatcgtgcgacgttacataaatat

SEQ ID NO: 2122 - DNA, 39 bp, Artificial Sequence
  Description of Artificial Sequence: Synthetic oligonucleotide
agcctggaagccaaggcgattgtggacaagaccatggat

SEQ ID NO: 2123 - DNA, 39 bp, Artificial Sequence
  Description of Artificial Sequence: Synthetic oligonucleotide
gaacatggcaagtctattgtggaacactctaaaaaaatt

SEQ ID NO: 2124 - DNA, 39 bp, Artificial Sequence
  Description of Artificial Sequence: Synthetic oligonucleotide
gcgcaggatttccgcaaaagcatggaattagcccgtgaa

SEQ ID NO: 2125 - DNA, 39 bp, Artificial Sequence
  Description of Artificial Sequence: Synthetic oligonucleotide
gaacaggatgttaacgcggcgcatgaccgcctggcgcgt

SEQ ID NO: 2126 - DNA, 39 bp, Artificial Sequence
  Description of Artificial Sequence: Synthetic oligonucleotide
accgatcagaaggttagcgaagcgaagcgcgcgatgcag

SEQ ID NO: 2127 - DNA, 39 bp, Artificial Sequence
  Description of Artificial Sequence: Synthetic oligonucleotide
gtgagcaccgttcaacgtagcgtgaagaagctgcatgaa

SEQ ID NO: 2128 - DNA, 39 bp, Artificial Sequence
  Description of Artificial Sequence: Synthetic oligonucleotide
accgaaaaaacgttaaaactggtgaagcaagcggaaaaa

SEQ ID NO: 2129 - DNA, 39 bp, Artificial Sequence
  Description of Artificial Sequence: Synthetic oligonucleotide
gaaaaaaccgttgagctgctgcgtaacgttctgaaagaa

SEQ ID NO: 2130 - DNA, 39 bp, Artificial Sequence
  Description of Artificial Sequence: Synthetic oligonucleotide
attgatgaagcccgccaggaactgcaccgcattattaat

SEQ ID NO: 2131 - DNA, 39 bp, Artificial Sequence
  Description of Artificial Sequence: Synthetic oligonucleotide
cgtgatgcgcaagccgtgcagcgtcaacgcgtggcggat

SEQ ID NO: 2132 - DNA, 39 bp, Artificial Sequence
  Description of Artificial Sequence: Synthetic oligonucleotide
acccgtgaaaagttaaatcgtattttatctgaacgtacc

SEQ ID NO: 2133 - DNA, 39 bp, Artificial Sequence
  Description of Artificial Sequence: Synthetic oligonucleotide
atttttgcgtctcgcaccctgattgaccgcctgaaagaa

SEQ ID NO: 2134 - DNA, 39 bp, Artificial Sequence
  Description of Artificial Sequence: Synthetic oligonucleotide
gcggatgcgcactctaatctggcgtctatccataaagat

SEQ ID NO: 2135 - DNA, 39 bp, Artificial Sequence
  Description of Artificial Sequence: Synthetic oligonucleotide
cgtcaggaatacgaggatattgcggttaagctgggcacc

SEQ ID NO: 2136 - DNA, 39 bp, Artificial Sequence
  Description of Artificial Sequence: Synthetic oligonucleotide
catcatgcgtggcaccgcctgctggatcaagccctgaat

SEQ ID NO: 2137 - DNA, 39 bp, Artificial Sequence
  Description of Artificial Sequence: Synthetic oligonucleotide
aaaagctataaggagctggtgaccttatctgcggaagaa

SEQ ID NO: 2138 - DNA, 39 bp, Artificial Sequence
  Description of Artificial Sequence: Synthetic oligonucleotide
ccgagccgtgaccgcctgctggcgcacttaggcaccgaa

SEQ ID NO: 2139 - DNA, 39 bp, Artificial Sequence
  Description of Artificial Sequence: Synthetic oligonucleotide
accgaaaaagcctgggaggtgctgaccaaggcccgtgcg

SEQ ID NO: 2140 - DNA, 39 bp, Artificial Sequence
  Description of Artificial Sequence: Synthetic oligonucleotide
gaatatcgtaagaagctgatggatggcttaacgaatcag

SEQ ID NO: 2141 - DNA, 39 bp, Artificial Sequence
  Description of Artificial Sequence: Synthetic oligonucleotide
aaagataaattaaagaatctgatttggatccacgaaaat

SEQ ID NO: 2142 - DNA, 39 bp, Artificial Sequence
  Description of Artificial Sequence: Synthetic oligonucleotide
gaacagtatcgcgagccgctgcgtaacgccctgaaagat

SEQ ID NO: 2143 - DNA, 39 bp, Artificial Sequence
  Description of Artificial Sequence: Synthetic oligonucleotide
aatgaagaaaagtcttataaaattccacgcgtgaatagc

SEQ ID NO: 2144 - DNA, 39 bp, Artificial Sequence
  Description of Artificial Sequence: Synthetic oligonucleotide
gaaagcaatttaaagcgtctgggcgccatccattttaaa

SEQ ID NO: 2145 - DNA, 39 bp, Artificial Sequence
  Description of Artificial Sequence: Synthetic oligonucleotide
gaacagctggcccgcaaagcggaagcccaagcgaaaaaa

SEQ ID NO: 2146 - DNA, 39 bp, Artificial Sequence
  Description of Artificial Sequence: Synthetic oligonucleotide
atgggccatgccgagaaaattgcgtctgagctgaaaacc

SEQ ID NO: 2147 - DNA, 39 bp, Artificial Sequence
  Description of Artificial Sequence: Synthetic oligonucleotide
caggaagatacgttcgcggcggaattacaccgtctgaaa

SEQ ID NO: 2148 - DNA, 39 bp, Artificial Sequence
  Description of Artificial Sequence: Synthetic oligonucleotide
ctggaaaccaacttacgtaaactgttcgacaaactgctg

SEQ ID NO: 2149 - DNA, 39 bp, Artificial Sequence
  Description of Artificial Sequence: Synthetic oligonucleotide
attaaagaaacgcaagaaatggtggatttctctattaaa

SEQ ID NO: 2150 - DNA, 39 bp, Artificial Sequence
  Description of Artificial Sequence: Synthetic oligonucleotide
gaaagcaccttatacccgattctgaagaagctggaaaaa

SEQ ID NO: 2151 - DNA, 39 bp, Artificial Sequence
  Description of Artificial Sequence: Synthetic oligonucleotide
ctgaaagaagttgagaccagcctgtctcgctttgaacag

SEQ ID NO: 2152 - DNA, 39 bp, Artificial Sequence
  Description of Artificial Sequence: Synthetic oligonucleotide
gaacaggtggccaaggaagcgcagaagatcctgaccaaa

SEQ ID NO: 2153 - DNA, 39 bp, Artificial Sequence
  Description of Artificial Sequence: Synthetic oligonucleotide
gaaaaagaaggtttagaagtgctgtctgccattcgtaat

SEQ ID NO: 2154 - DNA, 39 bp, Artificial Sequence
  Description of Artificial Sequence: Synthetic oligonucleotide
gaacgtgtgaaggagaccctgcgtacggttaaaaaagat

SEQ ID NO: 2155 - DNA, 39 bp, Artificial Sequence
  Description of Artificial Sequence: Synthetic oligonucleotide
gaaagcggccaaaaggaactgcagatccgctatgaaaaa

SEQ ID NO: 2156 - DNA, 39 bp, Artificial Sequence
  Description of Artificial Sequence: Synthetic oligonucleotide
gaaaaaagcttacgcaccatggatcgtttagttcgtgcg

SEQ ID NO: 2157 - DNA, 39 bp, Artificial Sequence
  Description of Artificial Sequence: Synthetic oligonucleotide
cagaaagatcgcgacatttttgtgaagaaggcggaaagc

SEQ ID NO: 2158 - DNA, 39 bp, Artificial Sequence
  Description of Artificial Sequence: Synthetic oligonucleotide
gcgaaagaattagccgaactggcgaaccgcgcggaaagc

SEQ ID NO: 2159 - DNA, 39 bp, Artificial Sequence
  Description of Artificial Sequence: Synthetic oligonucleotide
accagcaccatcttacgtgaagtggagttactgaaaaaa

SEQ ID NO: 2160 - DNA, 39 bp, Artificial Sequence
  Description of Artificial Sequence: Synthetic oligonucleotide
caggatgaacgcgacattgcggcgacggttcgtcagttt

SEQ ID NO: 2161 - DNA, 39 bp, Artificial Sequence
  Description of Artificial Sequence: Synthetic oligonucleotide
cgtaccgcgcacaacgcgcgtgaaaagttagcggaaagc

SEQ ID NO: 2162 - DNA, 39 bp, Artificial Sequence
  Description of Artificial Sequence: Synthetic oligonucleotide
gtgaaagaagccaagcagattgtgaaggactggaaaagc

SEQ ID NO: 2163 - DNA, 39 bp, Artificial Sequence
  Description of Artificial Sequence: Synthetic oligonucleotide
gataccaccaagaagattattgatgaggccctgtatcat

SEQ ID NO: 2164 - DNA, 39 bp, Artificial Sequence
  Description of Artificial Sequence: Synthetic oligonucleotide
accagcgaagccgttgaactggcgaagcacgcggaaaaa

SEQ ID NO: 2165 - DNA, 39 bp, Artificial Sequence
  Description of Artificial Sequence: Synthetic oligonucleotide
tatgaagtgaagcgcgcgcgtgaattaaaccagctgctg

SEQ ID NO: 2166 - DNA, 39 bp, Artificial Sequence
  Description of Artificial Sequence: Synthetic oligonucleotide
agcgaagtgaaggcctatgaaaccaaggttgcggtggaa

SEQ ID NO: 2167 - DNA, 39 bp, Artificial Sequence
  Description of Artificial Sequence: Synthetic oligonucleotide
gtgtgggcgttagacagcgaagtgaagtctctgcatcgt

SEQ ID NO: 2168 - DNA, 39 bp, Artificial Sequence
  Description of Artificial Sequence: Synthetic oligonucleotide
gaagaaaatcgcaaggcgtttgaaaaggccctggaaacc

SEQ ID NO: 2169 - DNA, 39 bp, Artificial Sequence
  Description of Artificial Sequence: Synthetic oligonucleotide
gatcagattgttaacaataaagtgaagaagggcctggaa

SEQ ID NO: 2170 - DNA, 39 bp, Artificial Sequence
  Description of Artificial Sequence: Synthetic oligonucleotide
gatggcctgatcgccgaacgtcagaagttactggatagc

SEQ ID NO: 2171 - DNA, 39 bp, Artificial Sequence
  Description of Artificial Sequence: Synthetic oligonucleotide
cagacccatgccaagcgtgcgtatcgcgagctggtgctg

SEQ ID NO: 2172 - DNA, 39 bp, Artificial Sequence
  Description of Artificial Sequence: Synthetic oligonucleotide
ccgcaggaaaagttaaaaaccgtgaaggagaattggaaa

SEQ ID NO: 2173 - DNA, 39 bp, Artificial Sequence
  Description of Artificial Sequence: Synthetic oligonucleotide
agcgaaaaattcttaaatgatctggttgacagcatgaaa

SEQ ID NO: 2174 - DNA, 39 bp, Artificial Sequence
  Description of Artificial Sequence: Synthetic oligonucleotide
ccggcgaatttcgaggcgcagatgaaacacttaaaagat

SEQ ID NO: 2175 - DNA, 39 bp, Artificial Sequence
  Description of Artificial Sequence: Synthetic oligonucleotide
catggcgaatctttacgtgtgcatgccttagcggaaagc

SEQ ID NO: 2176 - DNA, 39 bp, Artificial Sequence
  Description of Artificial Sequence: Synthetic oligonucleotide
cgtgaaaccgttacgaaagtgattggtgagctggcgcgt

SEQ ID NO: 2177 - DNA, 39 bp, Artificial Sequence
  Description of Artificial Sequence: Synthetic oligonucleotide
ctggcggatttccgccagaccattgacaaggtggatgcg

SEQ ID NO: 2178 - DNA, 39 bp, Artificial Sequence
  Description of Artificial Sequence: Synthetic oligonucleotide
aaaccggaaatccgcgcgctgaatgagttagcggatagc

SEQ ID NO: 2179 - DNA, 39 bp, Artificial Sequence
  Description of Artificial Sequence: Synthetic oligonucleotide
cgtgcggatgttaagagcgtgatggattctttaattcgt

SEQ ID NO: 2180 - DNA, 39 bp, Artificial Sequence
  Description of Artificial Sequence: Synthetic oligonucleotide
cagcgtcgtatcaagaaagtgacccacgacatggatatg

SEQ ID NO: 2181 - DNA, 39 bp, Artificial Sequence
  Description of Artificial Sequence: Synthetic oligonucleotide
cgtgaactggttaagaaagtgagcgacgttatttggaat

SEQ ID NO: 2182 - DNA, 39 bp, Artificial Sequence
  Description of Artificial Sequence: Synthetic oligonucleotide
gtgcagaccttacgcgaacgtctgatcgacgcgctggaa

SEQ ID NO: 2183 - DNA, 39 bp, Artificial Sequence
  Description of Artificial Sequence: Synthetic oligonucleotide
gatgtgcgtacggagcgtctgcgtgaccgcattacccag

SEQ ID NO: 2184 - DNA, 39 bp, Artificial Sequence
  Description of Artificial Sequence: Synthetic oligonucleotide
ctgagcaccgcccaaaaaattattaaggaggcgcgtgat

SEQ ID NO: 2185 - DNA, 39 bp, Artificial Sequence
  Description of Artificial Sequence: Synthetic oligonucleotide
gaagtgagctctcgcgtggtgcatgccatcaaagaagcg

SEQ ID NO: 2186 - DNA, 39 bp, Artificial Sequence
  Description of Artificial Sequence: Synthetic oligonucleotide
agccgtgtgtctcgctttgcggatttatctaaagaagtg

SEQ ID NO: 2187 - DNA, 39 bp, Artificial Sequence
  Description of Artificial Sequence: Synthetic oligonucleotide
gaaaaagtggagtctgaaattaaaaaggttgaaaatttt

SEQ ID NO: 2188 - DNA, 39 bp, Artificial Sequence
  Description of Artificial Sequence: Synthetic oligonucleotide
gaagatcgtttaaaccagattgtgcaagagctgcgtggc

SEQ ID NO: 2189 - DNA, 39 bp, Artificial Sequence
  Description of Artificial Sequence: Synthetic oligonucleotide
cgtattcgtgacgaggtgtttaaagttttacagcagcat

SEQ ID NO: 2190 - DNA, 39 bp, Artificial Sequence
  Description of Artificial Sequence: Synthetic oligonucleotide
ccggcgaccgttgaccgtacccatgccttaatgcgtaaa

SEQ ID NO: 2191 - DNA, 39 bp, Artificial Sequence
  Description of Artificial Sequence: Synthetic oligonucleotide
agcaaagtgatcatcgatcgtgtgacggagtatctggaa

SEQ ID NO: 2192 - DNA, 39 bp, Artificial Sequence
  Description of Artificial Sequence: Synthetic oligonucleotide
aaaagcgcgaagtctctgaaaccgttattcgatgaactg

SEQ ID NO: 2193 - DNA, 39 bp, Artificial Sequence
  Description of Artificial Sequence: Synthetic oligonucleotide
gtggataaacgcaacgaaaccaccttaaagctgattaaa

SEQ ID NO: 2194 - DNA, 39 bp, Artificial Sequence
  Description of Artificial Sequence: Synthetic oligonucleotide
aaagaaaccttattagcggatatgcgtcaagccgaacgt

SEQ ID NO: 2195 - DNA, 39 bp, Artificial Sequence
  Description of Artificial Sequence: Synthetic oligonucleotide
atggatattcaagcccgtattaaattcgagaccgaaggc

SEQ ID NO: 2196 - DNA, 39 bp, Artificial Sequence
  Description of Artificial Sequence: Synthetic oligonucleotide
gtgaaaagctacgacgaaattattaagaagctgagcgat

SEQ ID NO: 2197 - DNA, 39 bp, Artificial Sequence
  Description of Artificial Sequence: Synthetic oligonucleotide
aaagataccgttgagaaagtgcgtcaaacgtttgaaaat

SEQ ID NO: 2198 - DNA, 39 bp, Artificial Sequence
  Description of Artificial Sequence: Synthetic oligonucleotide
gatgaagtgtctacgaaaattctgatggagttcaataaa

SEQ ID NO: 2199 - DNA, 39 bp, Artificial Sequence
  Description of Artificial Sequence: Synthetic oligonucleotide
tttgataccgttgccgataaaattcactctgtgagccgt

SEQ ID NO: 2200 - DNA, 39 bp, Artificial Sequence
  Description of Artificial Sequence: Synthetic oligonucleotide
gaaaatgtgttagaggcggcgcgtcacttacatcagacc

SEQ ID NO: 2201 - DNA, 39 bp, Artificial Sequence
  Description of Artificial Sequence: Synthetic oligonucleotide
cgtgataaagttaacgatattgtggaccaagtgattacc

SEQ ID NO: 2202 - DNA, 39 bp, Artificial Sequence
  Description of Artificial Sequence: Synthetic oligonucleotide
cgtgaacgtgttgccagcctgctgaaggagcgtctgacc

SEQ ID NO: 2203 - DNA, 39 bp, Artificial Sequence
  Description of Artificial Sequence: Synthetic oligonucleotide
gtggataaacgcaacgaaaccaccttacgcctgattaaa

SEQ ID NO: 2204 - DNA, 39 bp, Artificial Sequence
  Description of Artificial Sequence: Synthetic oligonucleotide
gaaagcctggttgagaaagtgaaagagttcctgagcacc

SEQ ID NO: 2205 - DNA, 39 bp, Artificial Sequence
  Description of Artificial Sequence: Synthetic oligonucleotide
ccggataaagttaaggaatttgcgcaacgcattaccgcg

SEQ ID NO: 2206 - DNA, 39 bp, Artificial Sequence
  Description of Artificial Sequence: Synthetic oligonucleotide
ggcgaagcgaacgttaaaaaagaaatccaactgctgcgt

SEQ ID NO: 2207 - DNA, 39 bp, Artificial Sequence
  Description of Artificial Sequence: Synthetic oligonucleotide
cgtatgcgtgagcaactgaattttttagccgaagaactg

SEQ ID NO: 2208 - DNA, 39 bp, Artificial Sequence
  Description of Artificial Sequence: Synthetic oligonucleotide
gaaaaaaccttacgcgataaactggttttagcgaccgaa

SEQ ID NO: 2209 - DNA, 39 bp, Artificial Sequence
  Description of Artificial Sequence: Synthetic oligonucleotide
ccggatgcgacggccgaaaccaaagccttactgcatcgt

SEQ ID NO: 2210 - DNA, 39 bp, Artificial Sequence
  Description of Artificial Sequence: Synthetic oligonucleotide
gaaagcgcggttacggattttgcggcccgcctgcgtgaa

SEQ ID NO: 2211 - DNA, 39 bp, Artificial Sequence
  Description of Artificial Sequence: Synthetic oligonucleotide
attaccaaacacatggagcgttatctggacatcctgaat

SEQ ID NO: 2212 - DNA, 39 bp, Artificial Sequence
  Description of Artificial Sequence: Synthetic oligonucleotide
caggaatttcgcgaggcgattcgtaaggccctggtgagc

SEQ ID NO: 2213 - DNA, 39 bp, Artificial Sequence
  Description of Artificial Sequence: Synthetic oligonucleotide
gataataaattaaacgaaattggcgagaagtataaaaaa

SEQ ID NO: 2214 - DNA, 39 bp, Artificial Sequence
  Description of Artificial Sequence: Synthetic oligonucleotide
cgtgtgaccgttacgcgtctgctgggtgacctgcgtgaa

SEQ ID NO: 2215 - DNA, 39 bp, Artificial Sequence
  Description of Artificial Sequence: Synthetic oligonucleotide
gcgcagcgtttacacgaaattcgtacgcaactggtggaa

SEQ ID NO: 2216 - DNA, 39 bp, Artificial Sequence
  Description of Artificial Sequence: Synthetic oligonucleotide
ggcctggatcgcaaggaagtgcagcaattaaccgtgaaa

SEQ ID NO: 2217 - DNA, 39 bp, Artificial Sequence
  Description of Artificial Sequence: Synthetic oligonucleotide
accattgataaggttagcgatattgttaaggaaaaactg

SEQ ID NO: 2218 - DNA, 39 bp, Artificial Sequence
  Description of Artificial Sequence: Synthetic oligonucleotide
gcggtgctgaaggaccgtgtgagccgcaacagcgcggat

SEQ ID NO: 2219 - DNA, 39 bp, Artificial Sequence
  Description of Artificial Sequence: Synthetic oligonucleotide
ccgaaagcgcgccaagaagtggatcaccactggcaggcg

SEQ ID NO: 2220 - DNA, 39 bp, Artificial Sequence
  Description of Artificial Sequence: Synthetic oligonucleotide
aaagcgcattctatccgtctgcgtgccttagcgcaggaa

SEQ ID NO: 2221 - DNA, 39 bp, Artificial Sequence
  Description of Artificial Sequence: Synthetic oligonucleotide
accgcgatgctgaaggacaccaccgaattattaaaaaaa

SEQ ID NO: 2222 - DNA, 39 bp, Artificial Sequence
  Description of Artificial Sequence: Synthetic oligonucleotide
aaagatatgaaaaaggccgtgatggcgtttcaagaccag

SEQ ID NO: 2223 - DNA, 39 bp, Artificial Sequence
  Description of Artificial Sequence: Synthetic oligonucleotide
accagcctgatcaagctggtgaaagacaagattcgtgaa

SEQ ID NO: 2224 - DNA, 39 bp, Artificial Sequence
  Description of Artificial Sequence: Synthetic oligonucleotide
aaagatgtgcaaaagaccctgcagaacgacgtggataat

SEQ ID NO: 2225 - DNA, 39 bp, Artificial Sequence
  Description of Artificial Sequence: Synthetic oligonucleotide
accgtgagcttaacgaaaaaaattaaggaggcggtggat

SEQ ID NO: 2226 - DNA, 39 bp, Artificial Sequence
  Description of Artificial Sequence: Synthetic oligonucleotide
gatagcgatatcaaccgtggcattgccaaggcgctgaaa

SEQ ID NO: 2227 - DNA, 39 bp, Artificial Sequence
  Description of Artificial Sequence: Synthetic oligonucleotide
ggcgaagaattatctcatctgaaaaaggccctgaccatt

SEQ ID NO: 2228 - DNA, 39 bp, Artificial Sequence
  Description of Artificial Sequence: Synthetic oligonucleotide
aatgaagatttcgttcgtctgagcacggaggcgcgtaaa

SEQ ID NO: 2229 - DNA, 39 bp, Artificial Sequence
  Description of Artificial Sequence: Synthetic oligonucleotide
gatgatattgttgagcagcagaaaccaatcgcgattaaa

SEQ ID NO: 2230 - DNA, 39 bp, Artificial Sequence
  Description of Artificial Sequence: Synthetic oligonucleotide
gaagtgattacgtctgcgatggcgaaaaaggcccatgaa

SEQ ID NO: 2231 - DNA, 39 bp, Artificial Sequence
  Description of Artificial Sequence: Synthetic oligonucleotide
agcgatctggttgaccagggcaaagagcgcctgaatcgt

SEQ ID NO: 2232 - DNA, 39 bp, Artificial Sequence
  Description of Artificial Sequence: Synthetic oligonucleotide
agccatcgtgagatgacgagcaaactgttatctgatctg

SEQ ID NO: 2233 - DNA, 39 bp, Artificial Sequence
  Description of Artificial Sequence: Synthetic oligonucleotide
ctggcggaattaaagagctatcatcaagcccataaagcg

SEQ ID NO: 2234 - DNA, 39 bp, Artificial Sequence
  Description of Artificial Sequence: Synthetic oligonucleotide
aaaaccaaatctgttgcggaaattatccgcgatgaattt

SEQ ID NO: 2235 - DNA, 39 bp, Artificial Sequence
  Description of Artificial Sequence: Synthetic oligonucleotide
agcctgacccacgcctttaaactgttagacaaaattgat

SEQ ID NO: 2236 - DNA, 39 bp, Artificial Sequence
  Description of Artificial Sequence: Synthetic oligonucleotide
gcgagccaggttgagaaagatagcgacttaaatcagaaa

SEQ ID NO: 2237 - DNA, 39 bp, Artificial Sequence
  Description of Artificial Sequence: Synthetic oligonucleotide
gaagcggaaacgcgcgcgaccgtgcaaaagtataaaacc

SEQ ID NO: 2238 - DNA, 39 bp, Artificial Sequence
  Description of Artificial Sequence: Synthetic oligonucleotide
gataccgtgtacaagaaactggtgcaacgcgaaaaaacc

SEQ ID NO: 2239 - DNA, 39 bp, Artificial Sequence
  Description of Artificial Sequence: Synthetic oligonucleotide
aaagaaagcttagaggcgctggatgccgccaaaaccgcg

SEQ ID NO: 2240 - DNA, 39 bp, Artificial Sequence
  Description of Artificial Sequence: Synthetic oligonucleotide
cgtgaaaccgttcgccaggcgctgcgcgagctgctgatt

SEQ ID NO: 2241 - DNA, 39 bp, Artificial Sequence
  Description of Artificial Sequence: Synthetic oligonucleotide
gtgcagaaagacttagaacgtctgacgcaagaacgtatt

SEQ ID NO: 2242 - DNA, 39 bp, Artificial Sequence
  Description of Artificial Sequence: Synthetic oligonucleotide
accaccgatgttgagaaaagctttgacaagctgctgaaa

SEQ ID NO: 2243 - DNA, 39 bp, Artificial Sequence
  Description of Artificial Sequence: Synthetic oligonucleotide
gatcgtgcgttaacggcggcggtgaagatcagcgaacgt

SEQ ID NO: 2244 - DNA, 39 bp, Artificial Sequence
  Description of Artificial Sequence: Synthetic oligonucleotide
gtggaatttgttaagcatgaactgaaccgcctgctgagc

SEQ ID NO: 2245 - DNA, 39 bp, Artificial Sequence
  Description of Artificial Sequence: Synthetic oligonucleotide
accgcgaaagacatcgcggaagcgcaaaagatgctggat

SEQ ID NO: 2246 - DNA, 39 bp, Artificial Sequence
  Description of Artificial Sequence: Synthetic oligonucleotide
ccggaagatgttttaaaaaccgcgatcaagaccgtggaa

SEQ ID NO: 2247 - DNA, 39 bp, Artificial Sequence
  Description of Artificial Sequence: Synthetic oligonucleotide
caggaagtggaggttgcgaaaagcatcgccgaaaaactg

SEQ ID NO: 2248 - DNA, 39 bp, Artificial Sequence
  Description of Artificial Sequence: Synthetic oligonucleotide
cgtgaaaccgtttctcgtgtgctgcacgccctggcggaa

SEQ ID NO: 2249 - DNA, 39 bp, Artificial Sequence
  Description of Artificial Sequence: Synthetic oligonucleotide
ctgaaagatatctctattattatttctcactttgataaa

SEQ ID NO: 2250 - DNA, 39 bp, Artificial Sequence
  Description of Artificial Sequence: Synthetic oligonucleotide
caggcgaccgttcaaaaaattcgtgacgccattcgtgat

SEQ ID NO: 2251 - DNA, 39 bp, Artificial Sequence
  Description of Artificial Sequence: Synthetic oligonucleotide
gcggaaaaagttgacgcgattaatgacgttctgcgtagc

SEQ ID NO: 2252 - DNA, 39 bp, Artificial Sequence
  Description of Artificial Sequence: Synthetic oligonucleotide
gcggatattcgcaaggaagtggaacaaatcgataaaagc

SEQ ID NO: 2253 - DNA, 39 bp, Artificial Sequence
  Description of Artificial Sequence: Synthetic oligonucleotide
ctgaaaagccaccaagtgcgtctggttttagcggaaaaa

SEQ ID NO: 2254 - DNA, 39 bp, Artificial Sequence
  Description of Artificial Sequence: Synthetic oligonucleotide
gatgcggatatcttaagctgggcgaatcgcaaggtgcgt

SEQ ID NO: 2255 - DNA, 39 bp, Artificial Sequence
  Description of Artificial Sequence: Synthetic oligonucleotide
caggaaaccatcaagcatgtgaaagacttaattgcggaa

SEQ ID NO: 2256 - DNA, 39 bp, Artificial Sequence
  Description of Artificial Sequence: Synthetic oligonucleotide
gaaaaaattcaaaaggaagcgcaggaggccctggaaaaa

SEQ ID NO: 2257 - DNA, 39 bp, Artificial Sequence
  Description of Artificial Sequence: Synthetic oligonucleotide
gaagcgcgtgttcgcaatcagtttttaaaggaaatggat

SEQ ID NO: 2258 - DNA, 39 bp, Artificial Sequence
  Description of Artificial Sequence: Synthetic oligonucleotide
gaaaaagcgatcttaaatgtgaccaaggagtggaaaaaa

SEQ ID NO: 2259 - DNA, 39 bp, Artificial Sequence
  Description of Artificial Sequence: Synthetic oligonucleotide
catagccagtaccgcgaagaagcgttattaaatcgtctg

SEQ ID NO: 2260 - DNA, 39 bp, Artificial Sequence
  Description of Artificial Sequence: Synthetic oligonucleotide
attccggatgccgagcgtattctgaagacgctggaaacc

SEQ ID NO: 2261 - DNA, 39 bp, Artificial Sequence
  Description of Artificial Sequence: Synthetic oligonucleotide
accgaaaaatctaaggaactggcggagatcgtggtgcag

SEQ ID NO: 2262 - DNA, 39 bp, Artificial Sequence
  Description of Artificial Sequence: Synthetic oligonucleotide
cgtaaagatcgcgacaccgcgcgtcaattacatgaagtg

SEQ ID NO: 2263 - DNA, 39 bp, Artificial Sequence
  Description of Artificial Sequence: Synthetic oligonucleotide
gtgaaagaacaagagtggagcatggcggtggagcgcggc

SEQ ID NO: 2264 - DNA, 39 bp, Artificial Sequence
  Description of Artificial Sequence: Synthetic oligonucleotide
acccgtacccgcttaagctttgaaaaggccgcgcgtgaa

SEQ ID NO: 2265 - DNA, 39 bp, Artificial Sequence
  Description of Artificial Sequence: Synthetic oligonucleotide
cgtaaaagcgccgacaaagcgctggaggtttataaaagc

SEQ ID NO: 2266 - DNA, 39 bp, Artificial Sequence
  Description of Artificial Sequence: Synthetic oligonucleotide
tttaataccttaaagaataatatgaaagacatccatgat

SEQ ID NO: 2267 - DNA, 39 bp, Artificial Sequence
  Description of Artificial Sequence: Synthetic oligonucleotide
gatgcgcattctatccgtctgcgtgccttagcgcaggaa

SEQ ID NO: 2268 - DNA, 39 bp, Artificial Sequence
  Description of Artificial Sequence: Synthetic oligonucleotide
gatgcgacccgcgagcgtattaaatctgccgcgacccgt

SEQ ID NO: 2269 - DNA, 39 bp, Artificial Sequence
  Description of Artificial Sequence: Synthetic oligonucleotide
agcaaagcgaaggaccgtgtgatggatatcgcccgtacc

SEQ ID NO: 2270 - DNA, 39 bp, Artificial Sequence
  Description of Artificial Sequence: Synthetic oligonucleotide
agcgaaatggcgttaaagtggattaccaaaggtgagaaa

SEQ ID NO: 2271 - DNA, 39 bp, Artificial Sequence
  Description of Artificial Sequence: Synthetic oligonucleotide
attacccgtgactctgtgattcgtatcgccaaagatctg

SEQ ID NO: 2272 - DNA, 39 bp, Artificial Sequence
  Description of Artificial Sequence: Synthetic oligonucleotide
gaaaatgaagttggtgtggcgattcaagagaaactgcgt

SEQ ID NO: 2273 - DNA, 39 bp, Artificial Sequence
  Description of Artificial Sequence: Synthetic oligonucleotide
gataatgtgacgaaggatgtgtttgccgacctgaatcgt

SEQ ID NO: 2274 - DNA, 39 bp, Artificial Sequence
  Description of Artificial Sequence: Synthetic oligonucleotide
aaaaccctgaagaagattgcggaaaaggttgaaagcgaa

SEQ ID NO: 2275 - DNA, 39 bp, Artificial Sequence
  Description of Artificial Sequence: Synthetic oligonucleotide
atgaaagaaacgcaagaaatgattgatttcgccgcgaaa

SEQ ID NO: 2276 - DNA, 39 bp, Artificial Sequence
  Description of Artificial Sequence: Synthetic oligonucleotide
gaagcgcagaaggagaaatatctgccaaagctgattagc

SEQ ID NO: 2277 - DNA, 39 bp, Artificial Sequence
  Description of Artificial Sequence: Synthetic oligonucleotide
gtgcaggaaggtgttgataaaattcgccactttcaggaa

SEQ ID NO: 2278 - DNA, 39 bp, Artificial Sequence
  Description of Artificial Sequence: Synthetic oligonucleotide
cagatgctggagaagaatgcgcgtgaggccgtgaaagaa

SEQ ID NO: 2279 - DNA, 39 bp, Artificial Sequence
  Description of Artificial Sequence: Synthetic oligonucleotide
cgtgcggaagttgttcagcagctggagaaggaactgttt

SEQ ID NO: 2280 - DNA, 39 bp, Artificial Sequence
  Description of Artificial Sequence: Synthetic oligonucleotide
gataaagaacgctctattattagcgacatctttagccat

SEQ ID NO: 2281 - DNA, 39 bp, Artificial Sequence
  Description of Artificial Sequence: Synthetic oligonucleotide
gatcgtaatgacttaattacctatttaaagaaagcgacc

SEQ ID NO: 2282 - DNA, 39 bp, Artificial Sequence
  Description of Artificial Sequence: Synthetic oligonucleotide
gatcagcagaagaagaaatatctgggtcgcatgaccgaa

SEQ ID NO: 2283 - DNA, 39 bp, Artificial Sequence
  Description of Artificial Sequence: Synthetic oligonucleotide
gcggaagcggacaaggcgattcagcgctacgaaagcctg

SEQ ID NO: 2284 - DNA, 39 bp, Artificial Sequence
  Description of Artificial Sequence: Synthetic oligonucleotide
aaagcgaatcgcgagaaaatgacccagatcatgttcgaa

SEQ ID NO: 2285 - DNA, 39 bp, Artificial Sequence
  Description of Artificial Sequence: Synthetic oligonucleotide
cgtaaaattacggacgatctggtgaagaacgtggaaaaa

SEQ ID NO: 2286 - DNA, 39 bp, Artificial Sequence
  Description of Artificial Sequence: Synthetic oligonucleotide
atgattggcgaggagaccaaagcgcaaatcctggataaa

SEQ ID NO: 2287 - DNA, 39 bp, Artificial Sequence
  Description of Artificial Sequence: Synthetic oligonucleotide
gaacagattgccaaggaagcgctgaaggttctgaccaaa

SEQ ID NO: 2288 - DNA, 39 bp, Artificial Sequence
  Description of Artificial Sequence: Synthetic oligonucleotide
gaaaaactggttaagaatctgtttcaattagcgcgtgaa

SEQ ID NO: 2289 - DNA, 39 bp, Artificial Sequence
  Description of Artificial Sequence: Synthetic oligonucleotide
cgtcaggcgttaggtgaagcgcgtgaggttattaaaaat

SEQ ID NO: 2290 - DNA, 39 bp, Artificial Sequence
  Description of Artificial Sequence: Synthetic oligonucleotide
caggtgaccaaggacgcggcggaagccatcaaaaaacat

SEQ ID NO: 2291 - DNA, 39 bp, Artificial Sequence
  Description of Artificial Sequence: Synthetic oligonucleotide
aatgaacaggttgccgaaaaagtgaaggttgcgattgat

SEQ ID NO: 2292 - DNA, 39 bp, Artificial Sequence
  Description of Artificial Sequence: Synthetic oligonucleotide
tatgataaaacgacggaagtgattatccgcgatattcgt

SEQ ID NO: 2293 - DNA, 39 bp, Artificial Sequence
  Description of Artificial Sequence: Synthetic oligonucleotide
agcgatgaagttcgcaaaaatctgatggacatgttccgt

SEQ ID NO: 2294 - DNA, 39 bp, Artificial Sequence
  Description of Artificial Sequence: Synthetic oligonucleotide
gtggaaaccggtaagaaagtggtggagttaagcgaaaaa

SEQ ID NO: 2295 - DNA, 39 bp, Artificial Sequence
  Description of Artificial Sequence: Synthetic oligonucleotide
cgtaaaaatgttgagtatctggaaaagttacgtgaaagc

SEQ ID NO: 2296 - DNA, 39 bp, Artificial Sequence
  Description of Artificial Sequence: Synthetic oligonucleotide
ctgctgcgtgagacgaaagtgggcgttgaggtgaataaa

SEQ ID NO: 2297 - DNA, 39 bp, Artificial Sequence
  Description of Artificial Sequence: Synthetic oligonucleotide
ccgcgtacccgcgaggtgctgaaagagtggatcgcgagc

SEQ ID NO: 2298 - DNA, 39 bp, Artificial Sequence
  Description of Artificial Sequence: Synthetic oligonucleotide
agcaaagcggttaaggaagcgtatgagaacgcgcagaaa

SEQ ID NO: 2299 - DNA, 39 bp, Artificial Sequence
  Description of Artificial Sequence: Synthetic oligonucleotide
atggaaagcaaggcccgtctgctgtctttagtgaaagat

SEQ ID NO: 2300 - DNA, 39 bp, Artificial Sequence
  Description of Artificial Sequence: Synthetic oligonucleotide
gaagaaacccgcaacgcggtgtgggcggccatcaaagaa

SEQ ID NO: 2301 - DNA, 39 bp, Artificial Sequence
  Description of Artificial Sequence: Synthetic oligonucleotide
cagcatggctctcgctttattcagttaaagctggaacgt

SEQ ID NO: 2302 - DNA, 39 bp, Artificial Sequence
  Description of Artificial Sequence: Synthetic oligonucleotide
gatgaacgtatggcccaatttaccgcgcgcttaaatgaa

SEQ ID NO: 2303 - DNA, 39 bp, Artificial Sequence
  Description of Artificial Sequence: Synthetic oligonucleotide
gaacatgtgcaacgcctgctgctgtcttctcgtgaagcg

SEQ ID NO: 2304 - DNA, 39 bp, Artificial Sequence
  Description of Artificial Sequence: Synthetic oligonucleotide
aaaaatgaattagttcagaaagcgaagttagcggaacag

SEQ ID NO: 2305 - DNA, 39 bp, Artificial Sequence
  Description of Artificial Sequence: Synthetic oligonucleotide
gcggcggatcgcgacggcctgcgtgcccaatggcagcgt

SEQ ID NO: 2306 - DNA, 39 bp, Artificial Sequence
  Description of Artificial Sequence: Synthetic oligonucleotide
gatcgtattggtttcagcatgattagcgacgccgaaaaa

SEQ ID NO: 2307 - DNA, 39 bp, Artificial Sequence
  Description of Artificial Sequence: Synthetic oligonucleotide
gatgaagatgttcgcgaaaaactgcaagccagcctgaaa

SEQ ID NO: 2308 - DNA, 39 bp, Artificial Sequence
  Description of Artificial Sequence: Synthetic oligonucleotide
aaagaaaataagaagtttctgctggacttaatgctgaat

SEQ ID NO: 2309 - DNA, 39 bp, Artificial Sequence
  Description of Artificial Sequence: Synthetic oligonucleotide
gtgaaagaattagaggcgtataccgacgccattcagcgt

SEQ ID NO: 2310 - DNA, 39 bp, Artificial Sequence
  Description of Artificial Sequence: Synthetic oligonucleotide
aaagcgaaaatcgacccgattctggaggcccgtcagaat

SEQ ID NO: 2311 - DNA, 39 bp, Artificial Sequence
  Description of Artificial Sequence: Synthetic oligonucleotide
tgggaaagcgccgagaaagtggtgaagacgctgctgaaa

SEQ ID NO: 2312 - DNA, 39 bp, Artificial Sequence
  Description of Artificial Sequence: Synthetic oligonucleotide
attcaggaaatcgacaaagcgattaagaaggcggcgcag

SEQ ID NO: 2313 - DNA, 39 bp, Artificial Sequence
  Description of Artificial Sequence: Synthetic oligonucleotide
gcggaaaccatcaaggaactggcgcgcttatttgaaagc

SEQ ID NO: 2314 - DNA, 39 bp, Artificial Sequence
  Description of Artificial Sequence: Synthetic oligonucleotide
ccgaccaaattcgccgaaattgtggaggagaatctgaaa

SEQ ID NO: 2315 - DNA, 39 bp, Artificial Sequence
  Description of Artificial Sequence: Synthetic oligonucleotide
accgatattgttgaggcggtggcggagcgcctgcagcgt

SEQ ID NO: 2316 - DNA, 39 bp, Artificial Sequence
  Description of Artificial Sequence: Synthetic oligonucleotide
agcaaagaaatcgttaccctggtggaggactttcatcgt

SEQ ID NO: 2317 - DNA, 39 bp, Artificial Sequence
  Description of Artificial Sequence: Synthetic oligonucleotide
gatagcggccgcgagaccgtgcgtgccgccctgaaacat

SEQ ID NO: 2318 - DNA, 39 bp, Artificial Sequence
  Description of Artificial Sequence: Synthetic oligonucleotide
aaagcggatttacgcgaagcgattcaaacgatgctggat

SEQ ID NO: 2319 - DNA, 39 bp, Artificial Sequence
  Description of Artificial Sequence: Synthetic oligonucleotide
accctggaattaacgcgtcaggtgaaggagaaactggcg

SEQ ID NO: 2320 - DNA, 39 bp, Artificial Sequence
  Description of Artificial Sequence: Synthetic oligonucleotide
aaacagtatttagagctgatgcagaaagttttagatgaa

SEQ ID NO: 2321 - DNA, 39 bp, Artificial Sequence
  Description of Artificial Sequence: Synthetic oligonucleotide
ctggatctgacgaagattctgagcaagaagtataaagaa

SEQ ID NO: 2322 - DNA, 39 bp, Artificial Sequence
  Description of Artificial Sequence: Synthetic oligonucleotide
gtggatcaggccaagcgtattgcggacgagctgattagc

SEQ ID NO: 2323 - DNA, 39 bp, Artificial Sequence
  Description of Artificial Sequence: Synthetic oligonucleotide
gcggcgcagatcaagaaactgaaagaggccattgatagc

SEQ ID NO: 2324 - DNA, 39 bp, Artificial Sequence
  Description of Artificial Sequence: Synthetic oligonucleotide
gaaaaagaagccaaggatagcgcgatcacgtttattcag

SEQ ID NO: 2325 - DNA, 39 bp, Artificial Sequence
  Description of Artificial Sequence: Synthetic oligonucleotide
gatgcgcagcgccaagcgaccaaagacgccggccgtatt

SEQ ID NO: 2326 - DNA, 39 bp, Artificial Sequence
  Description of Artificial Sequence: Synthetic oligonucleotide
aaacagcagttcttaaaagtgctgaaggaggcggaaagc

SEQ ID NO: 2327 - DNA, 39 bp, Artificial Sequence
  Description of Artificial Sequence: Synthetic oligonucleotide
accctgaaagttttacgtcatcatcaagagaaactggaa

SEQ ID NO: 2328 - DNA, 39 bp, Artificial Sequence
  Description of Artificial Sequence: Synthetic oligonucleotide
accaaaattgccgagaaaattgatgagttcctggcgacc

SEQ ID NO: 2329 - DNA, 39 bp, Artificial Sequence
  Description of Artificial Sequence: Synthetic oligonucleotide
gaaaaactggccttagatctgctggagcaaattaaaaat

SEQ ID NO: 2330 - DNA, 39 bp, Artificial Sequence
  Description of Artificial Sequence: Synthetic oligonucleotide
gatatttttaacaagaatctgcgtgcccacgcgctggaa

SEQ ID NO: 2331 - DNA, 39 bp, Artificial Sequence
  Description of Artificial Sequence: Synthetic oligonucleotide
attcaggaaatcgttgataaagtgaagccacagctggaa

SEQ ID NO: 2332 - DNA, 39 bp, Artificial Sequence
  Description of Artificial Sequence: Synthetic oligonucleotide
atgaaacagtacttaaaaaccaaattattagaagaagtg

SEQ ID NO: 2333 - DNA, 39 bp, Artificial Sequence
  Description of Artificial Sequence: Synthetic oligonucleotide
ctggaagaattattcagcaaaattaagaacaccctgaaa

SEQ ID NO: 2334 - DNA, 39 bp, Artificial Sequence
  Description of Artificial Sequence: Synthetic oligonucleotide
cgtgatgaagttttagcgcagctggagaagagcctgaaa

SEQ ID NO: 2335 - DNA, 39 bp, Artificial Sequence
  Description of Artificial Sequence: Synthetic oligonucleotide
caggaaacccgcaagaaaaccatggtggacttagaaacc

SEQ ID NO: 2336 - DNA, 39 bp, Artificial Sequence
  Description of Artificial Sequence: Synthetic oligonucleotide
acctgggtgcgcgacgtggtgcgttctatggaccgtaaa

SEQ ID NO: 2337 - DNA, 39 bp, Artificial Sequence
  Description of Artificial Sequence: Synthetic oligonucleotide
gatatttttaacaagaatatgcgtgcgcacgccctggaa

SEQ ID NO: 2338 - DNA, 39 bp, Artificial Sequence
  Description of Artificial Sequence: Synthetic oligonucleotide
ctgcgtaaaacggccgatgattttttaaaccgtattgcg

SEQ ID NO: 2339 - DNA, 39 bp, Artificial Sequence
  Description of Artificial Sequence: Synthetic oligonucleotide
tttgatgtgaagatcgcggaacagatctctaaagaaacc

SEQ ID NO: 2340 - DNA, 39 bp, Artificial Sequence
  Description of Artificial Sequence: Synthetic oligonucleotide
gaagcgctgatccgcaaagcgagcgagatcagcattaaa

SEQ ID NO: 2341 - DNA, 39 bp, Artificial Sequence
  Description of Artificial Sequence: Synthetic oligonucleotide
gatgcgaaagcccgcgatgtggtgaaccgcctgaccgcg

SEQ ID NO: 2342 - DNA, 39 bp, Artificial Sequence
  Description of Artificial Sequence: Synthetic oligonucleotide
atggatcaggttatgaaggcgcatgaattataccagaaa

SEQ ID NO: 2343 - DNA, 39 bp, Artificial Sequence
  Description of Artificial Sequence: Synthetic oligonucleotide
ccgagcggcacgttcgtgcgtgaaaagatccgtgaaagc

SEQ ID NO: 2344 - DNA, 39 bp, Artificial Sequence
  Description of Artificial Sequence: Synthetic oligonucleotide
ctggaaaaagttcgcgaacaggtgcaagccgcgcatgcg

SEQ ID NO: 2345 - DNA, 39 bp, Artificial Sequence
  Description of Artificial Sequence: Synthetic oligonucleotide
cgtccgcgtgttgagcagattaccgccgagctgctggat

SEQ ID NO: 2346 - DNA, 39 bp, Artificial Sequence
  Description of Artificial Sequence: Synthetic oligonucleotide
cgtgatctggcctctcgtattgtgtctacgcagcatcat

SEQ ID NO: 2347 - DNA, 39 bp, Artificial Sequence
  Description of Artificial Sequence: Synthetic oligonucleotide
accagcctgatggagcgcgtgaccgaatacgccgaaaaa

SEQ ID NO: 2348 - DNA, 39 bp, Artificial Sequence
  Description of Artificial Sequence: Synthetic oligonucleotide
caggaaaataagaagaaaaccgtggttgactttgaaacc

SEQ ID NO: 2349 - DNA, 39 bp, Artificial Sequence
  Description of Artificial Sequence: Synthetic oligonucleotide
ctgaaagaaatctctgatctgattaagaaggaactgacc

SEQ ID NO: 2350 - DNA, 39 bp, Artificial Sequence
  Description of Artificial Sequence: Synthetic oligonucleotide
cgtaaaagcttaggtgaactgattcacacgctggatggc

SEQ ID NO: 2351 - DNA, 39 bp, Artificial Sequence
  Description of Artificial Sequence: Synthetic oligonucleotide
accgcgagcgttgacaaaaaatatgccgagctggtggat

SEQ ID NO: 2352 - DNA, 39 bp, Artificial Sequence
  Description of Artificial Sequence: Synthetic oligonucleotide
gcgcaggaattaaagcagctgattgacacggcgaaagaa

SEQ ID NO: 2353 - DNA, 39 bp, Artificial Sequence
  Description of Artificial Sequence: Synthetic oligonucleotide
gatgataaattagagcagattcgtaaggactataccagc

SEQ ID NO: 2354 - DNA, 39 bp, Artificial Sequence
  Description of Artificial Sequence: Synthetic oligonucleotide
tttaaacagttagttgaagatctggaccgcattctgacc

SEQ ID NO: 2355 - DNA, 39 bp, Artificial Sequence
  Description of Artificial Sequence: Synthetic oligonucleotide
ccgcgtcagaaggaggcgctggcgaagttccgtgaaaat

SEQ ID NO: 2356 - DNA, 39 bp, Artificial Sequence
  Description of Artificial Sequence: Synthetic oligonucleotide
gcggcgaccttagaggaaaaactgaacaagatttttgaa

SEQ ID NO: 2357 - DNA, 39 bp, Artificial Sequence
  Description of Artificial Sequence: Synthetic oligonucleotide
aaaaaaagcttaacggaaattaaagacgttctggcgagc

SEQ ID NO: 2358 - DNA, 39 bp, Artificial Sequence
  Description of Artificial Sequence: Synthetic oligonucleotide
cagaaagatttaaaggattgggtggaagccttaaatcag

SEQ ID NO: 2359 - DNA, 39 bp, Artificial Sequence
  Description of Artificial Sequence: Synthetic oligonucleotide
gaaaccacccgcttatggcgtgaagtggttacggaagtg

SEQ ID NO: 2360 - DNA, 39 bp, Artificial Sequence
  Description of Artificial Sequence: Synthetic oligonucleotide
aaagatgcgacgaacgaagcgattcgcgactggattacc

SEQ ID NO: 2361 - DNA, 39 bp, Artificial Sequence
  Description of Artificial Sequence: Synthetic oligonucleotide
tatgatgatatcaaggcggcgatgaaaacggccagcgaa

SEQ ID NO: 2362 - DNA, 39 bp, Artificial Sequence
  Description of Artificial Sequence: Synthetic oligonucleotide
gaaaaagtgatcaagtgggcggaacagaacgccgcggaa

SEQ ID NO: 2363 - DNA, 39 bp, Artificial Sequence
  Description of Artificial Sequence: Synthetic oligonucleotide
aaagaagaagaccaacgtgtgattaagttagtgcagaaa

SEQ ID NO: 2364 - DNA, 39 bp, Artificial Sequence
  Description of Artificial Sequence: Synthetic oligonucleotide
gaagaacaggttgacaaaattaatcaacgcctgaaagaa

SEQ ID NO: 2365 - DNA, 39 bp, Artificial Sequence
  Description of Artificial Sequence: Synthetic oligonucleotide
gtggatgaagccttaaaagatgcgcaaacgcgtattacc

SEQ ID NO: 2366 - DNA, 39 bp, Artificial Sequence
  Description of Artificial Sequence: Synthetic oligonucleotide
aatgaaacccgcgcctatgtgctggaccgcatgaaagaa

SEQ ID NO: 2367 - DNA, 39 bp, Artificial Sequence
  Description of Artificial Sequence: Synthetic oligonucleotide
aaagaagaattagttcgtctgattcaaacggcgcatgcg

SEQ ID NO: 2368 - DNA, 39 bp, Artificial Sequence
  Description of Artificial Sequence: Synthetic oligonucleotide
gaagcggaaaagacgggcgcgcaggagttactgcgtgtg

SEQ ID NO: 2369 - DNA, 39 bp, Artificial Sequence
  Description of Artificial Sequence: Synthetic oligonucleotide
ctggaagatttaaagctgaccaccgacttactgctgaaa

SEQ ID NO: 2370 - DNA, 39 bp, Artificial Sequence
  Description of Artificial Sequence: Synthetic oligonucleotide
ccggaatttcaagccaatgaagtgcgcaaggtgaaaaaa

SEQ ID NO: 2371 - DNA, 39 bp, Artificial Sequence
  Description of Artificial Sequence: Synthetic oligonucleotide
cgtgcggatttagaggcgaccctgcgcaagattaccgat

SEQ ID NO: 2372 - DNA, 39 bp, Artificial Sequence
  Description of Artificial Sequence: Synthetic oligonucleotide
ccgcgtgcgatcgagaccgcgaaagagaacgcgaaactg

SEQ ID NO: 2373 - DNA, 39 bp, Artificial Sequence
  Description of Artificial Sequence: Synthetic oligonucleotide
caggaagcgttatctgtggcgcgtgccttcgatgaaaaa

SEQ ID NO: 2374 - DNA, 39 bp, Artificial Sequence
  Description of Artificial Sequence: Synthetic oligonucleotide
aaagatcgtaacgacctgattacctacttaaaaaaagcg

SEQ ID NO: 2375 - DNA, 39 bp, Artificial Sequence
  Description of Artificial Sequence: Synthetic oligonucleotide
cgtgaaaccttattaaccatggcggaacgcgcccgtgcg

SEQ ID NO: 2376 - DNA, 39 bp, Artificial Sequence
  Description of Artificial Sequence: Synthetic oligonucleotide
gaaaccacccgcttagcgctgaaagccttagcgcgtcat

SEQ ID NO: 2377 - DNA, 39 bp, Artificial Sequence
  Description of Artificial Sequence: Synthetic oligonucleotide
attccgagcaagtaccgtgatgaattaacggcgaaactg

SEQ ID NO: 2378 - DNA, 39 bp, Artificial Sequence
  Description of Artificial Sequence: Synthetic oligonucleotide
gcgaaagtgtctgaggcgctggaaaagcgctatagcatg

SEQ ID NO: 2379 - DNA, 39 bp, Artificial Sequence
  Description of Artificial Sequence: Synthetic oligonucleotide
attagcgatacggttaaacgtgcgcgcgaggcgtttaat

SEQ ID NO: 2380 - DNA, 39 bp, Artificial Sequence
  Description of Artificial Sequence: Synthetic oligonucleotide
agcgatgatcgcaagaaacatctgttaatccgtgaacag

SEQ ID NO: 2381 - DNA, 39 bp, Artificial Sequence
  Description of Artificial Sequence: Synthetic oligonucleotide
accagcaccatctctgcgctggaacgcgttaaaaaagaa

SEQ ID NO: 2382 - DNA, 39 bp, Artificial Sequence
  Description of Artificial Sequence: Synthetic oligonucleotide
acccatgcgtctatcgatctgaccaagaaggcgaccgaa

SEQ ID NO: 2383 - DNA, 39 bp, Artificial Sequence
  Description of Artificial Sequence: Synthetic oligonucleotide
gaaacccgtatcaacattgtgaaattaacggaaaaaatt

SEQ ID NO: 2384 - DNA, 39 bp, Artificial Sequence
  Description of Artificial Sequence: Synthetic oligonucleotide
aaacagcgtatcgttgaagaagtgacgcgcctgctgaaa

SEQ ID NO: 2385 - DNA, 39 bp, Artificial Sequence
  Description of Artificial Sequence: Synthetic oligonucleotide
agcgaagatgccaagggcctgattaagtctgcgattcgt

SEQ ID NO: 2386 - DNA, 39 bp, Artificial Sequence
  Description of Artificial Sequence: Synthetic oligonucleotide
gtgcgtgatgagcgcaatgtgattcgcgccgcgagcaat

SEQ ID NO: 2387 - DNA, 39 bp, Artificial Sequence
  Description of Artificial Sequence: Synthetic oligonucleotide
ccgcgtgatgttgagaccctgctgcaaggtatgcgtgat

SEQ ID NO: 2388 - DNA, 39 bp, Artificial Sequence
  Description of Artificial Sequence: Synthetic oligonucleotide
gcgaaagatcgcgttgatctgcagttcggtgtggaacag

SEQ ID NO: 2389 - DNA, 39 bp, Artificial Sequence
  Description of Artificial Sequence: Synthetic oligonucleotide
accgatggcacgggtcatattcgtgccatcaaagaaagc

SEQ ID NO: 2390 - DNA, 39 bp, Artificial Sequence
  Description of Artificial Sequence: Synthetic oligonucleotide
caggaaagcgttaagagcaaagtgcaatacctgaaagat

SEQ ID NO: 2391 - DNA, 39 bp, Artificial Sequence
  Description of Artificial Sequence: Synthetic oligonucleotide
gaacagctgttacgcaaagcggaagcccaagcgaaaaaa

SEQ ID NO: 2392 - DNA, 39 bp, Artificial Sequence
  Description of Artificial Sequence: Synthetic oligonucleotide
gtggaaaatgttacggaactgaaaaagaactttaatcgt

SEQ ID NO: 2393 - DNA, 39 bp, Artificial Sequence
  Description of Artificial Sequence: Synthetic oligonucleotide
atgcgtcaggttgaggcgctggtggaggccagcaaagaa

SEQ ID NO: 2394 - DNA, 39 bp, Artificial Sequence
  Description of Artificial Sequence: Synthetic oligonucleotide
cgtgatcatttagagaattttgtgaagtctctggaagcg

SEQ ID NO: 2395 - DNA, 39 bp, Artificial Sequence
  Description of Artificial Sequence: Synthetic oligonucleotide
cagaaagaaatcgaccgtctgaatgaggttgcgaaaaat

SEQ ID NO: 2396 - DNA, 39 bp, Artificial Sequence
  Description of Artificial Sequence: Synthetic oligonucleotide
ctggatgaaatcatcagccgtgcgaagaaggcggaaacc

SEQ ID NO: 2397 - DNA, 39 bp, Artificial Sequence
  Description of Artificial Sequence: Synthetic oligonucleotide
ctggaaaaattaacgcaggatgtgttagacattgcgcgt

SEQ ID NO: 2398 - DNA, 39 bp, Artificial Sequence
  Description of Artificial Sequence: Synthetic oligonucleotide
gataaactgatctctgaaaccgcgaagtctgtgatgaaa

SEQ ID NO: 2399 - DNA, 39 bp, Artificial Sequence
  Description of Artificial Sequence: Synthetic oligonucleotide
cagcgtgtggaggccatgtttcataccttagacaaaatt

SEQ ID NO: 2400 - DNA, 39 bp, Artificial Sequence
  Description of Artificial Sequence: Synthetic oligonucleotide
gtgaccgaatctatcgatgcgcatttattagcgaaaaaa

SEQ ID NO: 2401 - DNA, 39 bp, Artificial Sequence
  Description of Artificial Sequence: Synthetic oligonucleotide
gaaggcctgtacgaccagattatgcgtgttaagaatgat

SEQ ID NO: 2402 - DNA, 39 bp, Artificial Sequence
  Description of Artificial Sequence: Synthetic oligonucleotide
aatcgtgaaatccgcgaaattaatcgcgtttataaagaa

SEQ ID NO: 2403 - DNA, 39 bp, Artificial Sequence
  Description of Artificial Sequence: Synthetic oligonucleotide
ctgaatgtgttagagcgtaaactgtctgagtttgataaa

SEQ ID NO: 2404 - DNA, 39 bp, Artificial Sequence
  Description of Artificial Sequence: Synthetic oligonucleotide
atgcgtgaacgcatcgaatttctgaacgaggcgagcgtg

SEQ ID NO: 2405 - DNA, 39 bp, Artificial Sequence
  Description of Artificial Sequence: Synthetic oligonucleotide
gaacagcatttacgcaaagcggaagcccaagcgaaaaaa

SEQ ID NO: 2406 - DNA, 39 bp, Artificial Sequence
  Description of Artificial Sequence: Synthetic oligonucleotide
gtggaagtgaagtctattgtggatttcatcaaaagccat

SEQ ID NO: 2407 - DNA, 39 bp, Artificial Sequence
  Description of Artificial Sequence: Synthetic oligonucleotide
gtggaagtgaagtctattgtggatttcgttaaaaatcat

SEQ ID NO: 2408 - DNA, 42 bp, Artificial Sequence
  Description of Artificial Sequence: Synthetic oligonucleotide
ggcacccattctaaggaacgtgaagtttggaaggaagcgctg

SEQ ID NO: 2409 - DNA, 42 bp, Artificial Sequence
  Description of Artificial Sequence: Synthetic oligonucleotide
aatggcaaaaaccgcgtgaaacagtgggacacgctggtggat

SEQ ID NO: 2410 - DNA, 42 bp, Artificial Sequence
  Description of Artificial Sequence: Synthetic oligonucleotide
gaaaaactgaagatcaaagcgcagtcttacctggatgccatt

SEQ ID NO: 2411 - DNA, 42 bp, Artificial Sequence
  Description of Artificial Sequence: Synthetic oligonucleotide
ccggaacaggttatcgcggaagcgatccgcaaaaaaacgcgt

SEQ ID NO: 2412 - DNA, 42 bp, Artificial Sequence
  Description of Artificial Sequence: Synthetic oligonucleotide
cgtgataaagttaacgatattgtggaccaagtgattacgatt

SEQ ID NO: 2413 - DNA, 42 bp, Artificial Sequence
  Description of Artificial Sequence: Synthetic oligonucleotide
gaagcggaaaagacggcggcgcaggagttactgaaagttctg

SEQ ID NO: 2414 - DNA, 42 bp, Artificial Sequence
  Description of Artificial Sequence: Synthetic oligonucleotide
cgtcatgtggccgagcgtgaaattgccacgctggcgggtagc

SEQ ID NO: 2415 - DNA, 42 bp, Artificial Sequence
  Description of Artificial Sequence: Synthetic oligonucleotide
aatcaggatgagttaaaaaaactggccgccaccgaagccgcg

SEQ ID NO: 2416 - DNA, 42 bp, Artificial Sequence
  Description of Artificial Sequence: Synthetic oligonucleotide
ctgatggataacgcccgtgtggtggaccaactgatgaaagat

SEQ ID NO: 2417 - DNA, 42 bp, Artificial Sequence
  Description of Artificial Sequence: Synthetic oligonucleotide
acccatctgcaagttatggcgaaagaacgcttccatgcgggc

SEQ ID NO: 2418 - DNA, 42 bp, Artificial Sequence
  Description of Artificial Sequence: Synthetic oligonucleotide
gaactgagcaaccgcattcgtgaacacggtcgtaatatcgcg

SEQ ID NO: 2419 - DNA, 42 bp, Artificial Sequence
  Description of Artificial Sequence: Synthetic oligonucleotide
aatgtgcgtgagttaaaaaatgtgatcgagcgtgcggttctg

SEQ ID NO: 2420 - DNA, 42 bp, Artificial Sequence
  Description of Artificial Sequence: Synthetic oligonucleotide
ccgacccgtgacgttgtgcagcgtgccttagcggaattagaa

SEQ ID NO: 2421 - DNA, 42 bp, Artificial Sequence
  Description of Artificial Sequence: Synthetic oligonucleotide
aatgaacgtaacgaggcgctgctgaagcgcattaatggtcgt

SEQ ID NO: 2422 - DNA, 42 bp, Artificial Sequence
  Description of Artificial Sequence: Synthetic oligonucleotide
cgtgaagaattaacggcggtgatgcgtttcttaacccagcgt

SEQ ID NO: 2423 - DNA, 42 bp, Artificial Sequence
  Description of Artificial Sequence: Synthetic oligonucleotide
caggaacgtgccaaggaactggcggagaacgcgagcttcatt

SEQ ID NO: 2424 - DNA, 42 bp, Artificial Sequence
  Description of Artificial Sequence: Synthetic oligonucleotide
tatcgtggcaagatcgaaaaagcggttgacctgacctctagc

SEQ ID NO: 2425 - DNA, 42 bp, Artificial Sequence
  Description of Artificial Sequence: Synthetic oligonucleotide
cgtcagcataacttcgaagtggcgaaggagctgctggagacc

SEQ ID NO: 2426 - DNA, 42 bp, Artificial Sequence
  Description of Artificial Sequence: Synthetic oligonucleotide
gatccggtgaaccaacatgtgatttctgagggcctgaagaaa

SEQ ID NO: 2427 - DNA, 42 bp, Artificial Sequence
  Description of Artificial Sequence: Synthetic oligonucleotide
tttcgtgatttagccctgcgtgtggaccaaattcgtgacaat

SEQ ID NO: 2428 - DNA, 42 bp, Artificial Sequence
  Description of Artificial Sequence: Synthetic oligonucleotide
gaaaaactgttagacaaagcgcagcgcatcgtgaccaacagc

SEQ ID NO: 2429 - DNA, 42 bp, Artificial Sequence
  Description of Artificial Sequence: Synthetic oligonucleotide
catcaggcgatgcgcgccgcgggcgatgagttcgaaacccgt

SEQ ID NO: 2430 - DNA, 42 bp, Artificial Sequence
  Description of Artificial Sequence: Synthetic oligonucleotide
cgtaaaaccatgttagagctggtggaaaaggttgcggaacag

SEQ ID NO: 2431 - DNA, 42 bp, Artificial Sequence
  Description of Artificial Sequence: Synthetic oligonucleotide
cgtctggaaaacgacattattcgtttaatcaatcgtacggtg

SEQ ID NO: 2432 - DNA, 42 bp, Artificial Sequence
  Description of Artificial Sequence: Synthetic oligonucleotide
ctgagcgatttcaaggaactgctgcgcacggtgaaagccacc

SEQ ID NO: 2433 - DNA, 42 bp, Artificial Sequence
  Description of Artificial Sequence: Synthetic oligonucleotide
gaagatgaagttaagaccctgctggagttaaaaaccaagtat

SEQ ID NO: 2434 - DNA, 42 bp, Artificial Sequence
  Description of Artificial Sequence: Synthetic oligonucleotide
gcgcagattacggaggcgattgatggtgttcgtgaacgcctg

SEQ ID NO: 2435 - DNA, 42 bp, Artificial Sequence
  Description of Artificial Sequence: Synthetic oligonucleotide
cagaatcgtttcgacagcctgattacggagctgggcaaggaa

SEQ ID NO: 2436 - DNA, 42 bp, Artificial Sequence
  Description of Artificial Sequence: Synthetic oligonucleotide
ccggataaaatcgagaaaattctgtctacgctggtgaagggc

SEQ ID NO: 2437 - DNA, 42 bp, Artificial Sequence
  Description of Artificial Sequence: Synthetic oligonucleotide
ccggatattcgcgagcgttttaccaagtctcgtgatgccacc

SEQ ID NO: 2438 - DNA, 42 bp, Artificial Sequence
  Description of Artificial Sequence: Synthetic oligonucleotide
ctgcgtgatcgcatcaaaagcaaagttgacgaacagttcgat

SEQ ID NO: 2439 - DNA, 42 bp, Artificial Sequence
  Description of Artificial Sequence: Synthetic oligonucleotide
cagcgtgatcgcttacgtagctatcgcttactggcggaggcg

SEQ ID NO: 2440 - DNA, 42 bp, Artificial Sequence
  Description of Artificial Sequence: Synthetic oligonucleotide
ctggatgaagccatccagctggcgaaggccctggaaaagaat

SEQ ID NO: 2441 - DNA, 42 bp, Artificial Sequence
  Description of Artificial Sequence: Synthetic oligonucleotide
gaagaatatttaacgagcctgggccgcaagcatcgtgccgtg

SEQ ID NO: 2442 - DNA, 42 bp, Artificial Sequence
  Description of Artificial Sequence: Synthetic oligonucleotide
ctgaaaagcacgcaaaccgtgattcacaaggcgctggagaaa

SEQ ID NO: 2443 - DNA, 42 bp, Artificial Sequence
  Description of Artificial Sequence: Synthetic oligonucleotide
gaaaaaagcttcaaggcgctgatgcatttagttagcaatgaa

SEQ ID NO: 2444 - DNA, 42 bp, Artificial Sequence
  Description of Artificial Sequence: Synthetic oligonucleotide
atgaaagaagttgacgaacagatgctgaacgttcagaataaa

SEQ ID NO: 2445 - DNA, 42 bp, Artificial Sequence
  Description of Artificial Sequence: Synthetic oligonucleotide
accgtggaaatgttagttaaagtgatttctgagcataaaaat

SEQ ID NO: 2446 - DNA, 42 bp, Artificial Sequence
  Description of Artificial Sequence: Synthetic oligonucleotide
gcggatgaagttgttaaagtggcgaactgggccaaagataat

SEQ ID NO: 2447 - DNA, 42 bp, Artificial Sequence
  Description of Artificial Sequence: Synthetic oligonucleotide
ggcgatacccacaagcgtatttgggatgccgttgcgagcgcg

SEQ ID NO: 2448 - DNA, 42 bp, Artificial Sequence
  Description of Artificial Sequence: Synthetic oligonucleotide
aatagcgaattaatccgtctgagcatggttttaaaagaaaaa

SEQ ID NO: 2449 - DNA, 42 bp, Artificial Sequence
  Description of Artificial Sequence: Synthetic oligonucleotide
ccggaagataaggttaaagcggtgacgaagctgaatcaacat

SEQ ID NO: 2450 - DNA, 42 bp, Artificial Sequence
  Description of Artificial Sequence: Synthetic oligonucleotide
aaagaaggcaaggccaccgtggaagccttaattaataagtat

SEQ ID NO: 2451 - DNA, 42 bp, Artificial Sequence
  Description of Artificial Sequence: Synthetic oligonucleotide
gatgatgaaaagaacgtggcgattgccaagtatagccaactg

SEQ ID NO: 2452 - DNA, 42 bp, Artificial Sequence
  Description of Artificial Sequence: Synthetic oligonucleotide
ccgaccaccgacgccctggaaaaaaagttagcggtgttagaa

SEQ ID NO: 2453 - DNA, 42 bp, Artificial Sequence
  Description of Artificial Sequence: Synthetic oligonucleotide
cgtgaagtgttagccgaaaaagtgaagaacgcggtgaacaat

SEQ ID NO: 2454 - DNA, 42 bp, Artificial Sequence
  Description of Artificial Sequence: Synthetic oligonucleotide
cagaccgtggaccgcctgcattttatcaagcgtatgcaggaa

SEQ ID NO: 2455 - DNA, 42 bp, Artificial Sequence
  Description of Artificial Sequence: Synthetic oligonucleotide
gaacgtcaggttcgcattcagctgaaggaccatattgaccgt

SEQ ID NO: 2456 - DNA, 42 bp, Artificial Sequence
  Description of Artificial Sequence: Synthetic oligonucleotide
aaagaaaccatcgacaaagtgagcgacatcgtgaaagagaaa

SEQ ID NO: 2457 - DNA, 42 bp, Artificial Sequence
  Description of Artificial Sequence: Synthetic oligonucleotide
gtggatgatacgtctgatgtgattgacgccctgcgtaagcgt

SEQ ID NO: 2458 - DNA, 42 bp, Artificial Sequence
  Description of Artificial Sequence: Synthetic oligonucleotide
gcggcgagcatcgacgcggtgtttgagacgctggaaaagaaa

SEQ ID NO: 2459 - DNA, 42 bp, Artificial Sequence
  Description of Artificial Sequence: Synthetic oligonucleotide
cgtgaacagttaacgcagctggtggagttcgcgaaaaagaat

SEQ ID NO: 2460 - DNA, 42 bp, Artificial Sequence
  Description of Artificial Sequence: Synthetic oligonucleotide
ctgagcaccgcccaaaaaattattaaggaggcgcgtgacgcg

SEQ ID NO: 2461 - DNA, 42 bp, Artificial Sequence
  Description of Artificial Sequence: Synthetic oligonucleotide
aatgaaaaaacggccgaactgattaaggagctgaaagagaaa

SEQ ID NO: 2462 - DNA, 42 bp, Artificial Sequence
  Description of Artificial Sequence: Synthetic oligonucleotide
aaagaagtggttaaggcgaatattgacaagattaaatctctg

SEQ ID NO: 2463 - DNA, 42 bp, Artificial Sequence
  Description of Artificial Sequence: Synthetic oligonucleotide
gatgaaagccgcggtaaagcgcgtgccgccggcgtggagagc

SEQ ID NO: 2464 - DNA, 42 bp, Artificial Sequence
  Description of Artificial Sequence: Synthetic oligonucleotide
gcggaagtgcactctcagtttgatgccttaaaagcgcgcatt

SEQ ID NO: 2465 - DNA, 42 bp, Artificial Sequence
  Description of Artificial Sequence: Synthetic oligonucleotide
ccgggccagcgcgagaaactgttttctaagctgattgacatt

SEQ ID NO: 2466 - DNA, 42 bp, Artificial Sequence
  Description of Artificial Sequence: Synthetic oligonucleotide
aataaagcggcccgcgaaatgaaagaacgcgttggccagacc

SEQ ID NO: 2467 - DNA, 42 bp, Artificial Sequence
  Description of Artificial Sequence: Synthetic oligonucleotide
ccggatcaggttaaggcgagcattgaccacatttttaaggaa

SEQ ID NO: 2468 - DNA, 42 bp, Artificial Sequence
  Description of Artificial Sequence: Synthetic oligonucleotide
gaagtgattacgtctgcgatggcgaaaaaggcccatgaactg

SEQ ID NO: 2469 - DNA, 42 bp, Artificial Sequence
  Description of Artificial Sequence: Synthetic oligonucleotide
aaagataaaacgaagggcgatgcgatcgacctgagcaacgcg

SEQ ID NO: 2470 - DNA, 42 bp, Artificial Sequence
  Description of Artificial Sequence: Synthetic oligonucleotide
gcggatcatttattaaaagcgcatttacaaaaactgatgagc

SEQ ID NO: 2471 - DNA, 42 bp, Artificial Sequence
  Description of Artificial Sequence: Synthetic oligonucleotide
agcctgcagatcatggagaaaattattaagaaggcgggcgat

SEQ ID NO: 2472 - DNA, 42 bp, Artificial Sequence
  Description of Artificial Sequence: Synthetic oligonucleotide
agcaaagaaatcttagcggaagcgaagaagctgaatgacgcg

SEQ ID NO: 2473 - DNA, 42 bp, Artificial Sequence
  Description of Artificial Sequence: Synthetic oligonucleotide
gaaaaagtggagtctgaaattaaaaaggttgaaaatttcctg

SEQ ID NO: 2474 - DNA, 42 bp, Artificial Sequence
  Description of Artificial Sequence: Synthetic oligonucleotide
gcggatcgtgttttaaaagaatttaaggacctgctgaacagc

SEQ ID NO: 2475 - DNA, 42 bp, Artificial Sequence
  Description of Artificial Sequence: Synthetic oligonucleotide
gcggaatttttagttaaaagcaaacaccgcgatctgacggcg

SEQ ID NO: 2476 - DNA, 42 bp, Artificial Sequence
  Description of Artificial Sequence: Synthetic oligonucleotide
aaagaaacctctgacctgctgcgtaagatcgcggcggacagc

SEQ ID NO: 2477 - DNA, 42 bp, Artificial Sequence
  Description of Artificial Sequence: Synthetic oligonucleotide
catcgtgatgacgttgcggaagtgacgaagctgctggccacc

SEQ ID NO: 2478 - DNA, 42 bp, Artificial Sequence
  Description of Artificial Sequence: Synthetic oligonucleotide
ccggaaaccggtgagagcgcggcgcgccacctggaacgcgcg

SEQ ID NO: 2479 - DNA, 42 bp, Artificial Sequence
  Description of Artificial Sequence: Synthetic oligonucleotide
tttgatgatgccttaaatattgtgcgcaagattggcgagaat

SEQ ID NO: 2480 - DNA, 42 bp, Artificial Sequence
  Description of Artificial Sequence: Synthetic oligonucleotide
cgtgaaaaattagaggcggcggcgtctcgcattgcgtctctg

SEQ ID NO: 2481 - DNA, 42 bp, Artificial Sequence
  Description of Artificial Sequence: Synthetic oligonucleotide
caggaaggcttacgcaaacattttggtaaggtggcggagagc

SEQ ID NO: 2482 - DNA, 42 bp, Artificial Sequence
  Description of Artificial Sequence: Synthetic oligonucleotide
cgtaaactgatcgacgatgcggtggcctgggccaaacagcag

SEQ ID NO: 2483 - DNA, 42 bp, Artificial Sequence
  Description of Artificial Sequence: Synthetic oligonucleotide
gatgcggataaggagaatattattgccttaagcaaagccctg

SEQ ID NO: 2484 - DNA, 42 bp, Artificial Sequence
  Description of Artificial Sequence: Synthetic oligonucleotide
ccgcgtaccttaaacgcgtgggtgaaattagttgaagaaaaa

SEQ ID NO: 2485 - DNA, 42 bp, Artificial Sequence
  Description of Artificial Sequence: Synthetic oligonucleotide
attcagcgtcgcatcaaaaaagtgacgcacgatatggatatg

SEQ ID NO: 2486 - DNA, 42 bp, Artificial Sequence
  Description of Artificial Sequence: Synthetic oligonucleotide
tttgatgatgccttacgtctgacccaaaagctgaccgaggcg

SEQ ID NO: 2487 - DNA, 42 bp, Artificial Sequence
  Description of Artificial Sequence: Synthetic oligonucleotide
aaagatcgtggtatgacgctggcggtgtctaaggcggtggaa

SEQ ID NO: 2488 - DNA, 42 bp, Artificial Sequence
  Description of Artificial Sequence: Synthetic oligonucleotide
ctgagcgattacatcaaactgaccaaggagaatatgcgtaaa

SEQ ID NO: 2489 - DNA, 42 bp, Artificial Sequence
  Description of Artificial Sequence: Synthetic oligonucleotide
gatcgtctgacgcgcgcggcgaaagttttagaacagttaagc

SEQ ID NO: 2490 - DNA, 42 bp, Artificial Sequence
  Description of Artificial Sequence: Synthetic oligonucleotide
gtgagcgaagttaaggcgattattaagaagcaggtggacgaa

SEQ ID NO: 2491 - DNA, 42 bp, Artificial Sequence
  Description of Artificial Sequence: Synthetic oligonucleotide
atgagcgcggttgttaaaaaagtggccgaccgtctgacggaa

SEQ ID NO: 2492 - DNA, 42 bp, Artificial Sequence
  Description of Artificial Sequence: Synthetic oligonucleotide
gcggtgaatcacatcaaaagcgtgtggaaggacctgctggaa

SEQ ID NO: 2493 - DNA, 42 bp, Artificial Sequence
  Description of Artificial Sequence: Synthetic oligonucleotide
catcatgaattaacgcgtgtggcgtctgccctgcgtaagctg

SEQ ID NO: 2494 - DNA, 42 bp, Artificial Sequence
  Description of Artificial Sequence: Synthetic oligonucleotide
cgtaatgatatcgttcagagcctggagaaggcggtggacatg

SEQ ID NO: 2495 - DNA, 42 bp, Artificial Sequence
  Description of Artificial Sequence: Synthetic oligonucleotide
gcgcaggcggacttactgaatctgaagcgcaaagtggacgcg

SEQ ID NO: 2496 - DNA, 42 bp, Artificial Sequence
  Description of Artificial Sequence: Synthetic oligonucleotide
ctggatcgtttccaagaagcgatttctgccattcgtgaggtg

SEQ ID NO: 2497 - DNA, 42 bp, Artificial Sequence
  Description of Artificial Sequence: Synthetic oligonucleotide
gtgaatgaaatcgacaaaattgtggagcgcacccgtgagctg

SEQ ID NO: 2498 - DNA, 42 bp, Artificial Sequence
  Description of Artificial Sequence: Synthetic oligonucleotide
cgtggctttttaaagcagctgcgtgagttagataaacaactg

SEQ ID NO: 2499 - DNA, 42 bp, Artificial Sequence
  Description of Artificial Sequence: Synthetic oligonucleotide
cgtctggaacgcgcccgtcagatgggcgcctctctggaagcg

SEQ ID NO: 2500 - DNA, 42 bp, Artificial Sequence
  Description of Artificial Sequence: Synthetic oligonucleotide
ctggatctggcccgcaaagaactgaagaagatgcaggatcag

SEQ ID NO: 2501 - DNA, 42 bp, Artificial Sequence
  Description of Artificial Sequence: Synthetic oligonucleotide
ctgaatcagttaaagcgtattgtggacaaggcgagcgagctg

SEQ ID NO: 2502 - DNA, 42 bp, Artificial Sequence
  Description of Artificial Sequence: Synthetic oligonucleotide
gaaaaaattatcaaggaatttattacgaagaccctgacggat

SEQ ID NO: 2503 - DNA, 42 bp, Artificial Sequence
  Description of Artificial Sequence: Synthetic oligonucleotide
ctggaagtgtctcgcgcggcggaacgcgtttttaaaaagcag

SEQ ID NO: 2504 - DNA, 42 bp, Artificial Sequence
  Description of Artificial Sequence: Synthetic oligonucleotide
cgtaccaccgagaagaaaattatggataagttagtgcaggaa

SEQ ID NO: 2505 - DNA, 42 bp, Artificial Sequence
  Description of Artificial Sequence: Synthetic oligonucleotide
gatcgtgcggagatggttgaaacccagaagacgtttaccctg

SEQ ID NO: 2506 - DNA, 42 bp, Artificial Sequence
  Description of Artificial Sequence: Synthetic oligonucleotide
gaagatctgaagcaaaaagtgctggacaactggaccaaaatg

SEQ ID NO: 2507 - DNA, 42 bp, Artificial Sequence
  Description of Artificial Sequence: Synthetic oligonucleotide
cgtcatatggtgcacgagctggtgagcaacttacgtaaagaa

SEQ ID NO: 2508 - DNA, 42 bp, Artificial Sequence
  Description of Artificial Sequence: Synthetic oligonucleotide
ctggcgaccttagagcgttatgtggagacgcaggcgaaggaa

SEQ ID NO: 2509 - DNA, 42 bp, Artificial Sequence
  Description of Artificial Sequence: Synthetic oligonucleotide
gaagatctgatctggaagctgctgagcaaggcccaggaaaaa

SEQ ID NO: 2510 - DNA, 42 bp, Artificial Sequence
  Description of Artificial Sequence: Synthetic oligonucleotide
caggattatgttaaggaactgcatcaacaaattacccgcctg

SEQ ID NO: 2511 - DNA, 42 bp, Artificial Sequence
  Description of Artificial Sequence: Synthetic oligonucleotide
cgtgatcatgagacgagccatagcttagcccgtgaagtttat

SEQ ID NO: 2512 - DNA, 42 bp, Artificial Sequence
  Description of Artificial Sequence: Synthetic oligonucleotide
aaagcggaagttttaaaagatgaaaactctcgtctgaacgcg

SEQ ID NO: 2513 - DNA, 42 bp, Artificial Sequence
  Description of Artificial Sequence: Synthetic oligonucleotide
gaagcgctgatccgcaaagcgagcgagatcagcattaaggcg

SEQ ID NO: 2514 - DNA, 42 bp, Artificial Sequence
  Description of Artificial Sequence: Synthetic oligonucleotide
gaaagcctggttgaccagcgtattaaggaggcgctgtctcgt

SEQ ID NO: 2515 - DNA, 42 bp, Artificial Sequence
  Description of Artificial Sequence: Synthetic oligonucleotide
ccgaaactgttacaccgtgtggtggagcaactgcagaaggtg

SEQ ID NO: 2516 - DNA, 42 bp, Artificial Sequence
  Description of Artificial Sequence: Synthetic oligonucleotide
agcgaaaatcaagttattgcggtggacacgcagcgtgagaaa

SEQ ID NO: 2517 - DNA, 42 bp, Artificial Sequence
  Description of Artificial Sequence: Synthetic oligonucleotide
cgtgaactggcccgccagattatggatgttgttaccgaaatg

SEQ ID NO: 2518 - DNA, 42 bp, Artificial Sequence
  Description of Artificial Sequence: Synthetic oligonucleotide
catgcgcaggccgttgattatattaagaagctgatgaccaaa

SEQ ID NO: 2519 - DNA, 42 bp, Artificial Sequence
  Description of Artificial Sequence: Synthetic oligonucleotide
agcaccgataaggacaccctggcggttttcgtggatcgcgtg

SEQ ID NO: 2520 - DNA, 42 bp, Artificial Sequence
  Description of Artificial Sequence: Synthetic oligonucleotide
gcggatgaatctatcgatattgtgaaggccgtgaaaacgcgt

SEQ ID NO: 2521 - DNA, 42 bp, Artificial Sequence
  Description of Artificial Sequence: Synthetic oligonucleotide
gataaaagccacgaccaggcggtgcgcacgtatcaggagcat

SEQ ID NO: 2522 - DNA, 42 bp, Artificial Sequence
  Description of Artificial Sequence: Synthetic oligonucleotide
tgggtggataaggttaaagatctgacgaagagcgaaatgaat

SEQ ID NO: 2523 - DNA, 42 bp, Artificial Sequence
  Description of Artificial Sequence: Synthetic oligonucleotide
aaagatgaaatgaagaagattctggaagacttcctgaatacc

SEQ ID NO: 2524 - DNA, 42 bp, Artificial Sequence
  Description of Artificial Sequence: Synthetic oligonucleotide
accgataccttagagcgtgtgaccgagatctttaaagccctg

SEQ ID NO: 2525 - DNA, 42 bp, Artificial Sequence
  Description of Artificial Sequence: Synthetic oligonucleotide
gtgcgtgatgttcgcgatgaaagcaacaagctgattgccaaa

SEQ ID NO: 2526 - DNA, 42 bp, Artificial Sequence
  Description of Artificial Sequence: Synthetic oligonucleotide
cgtgaagcgttacgcgcggaatggcaggccacggcgaaagaa

SEQ ID NO: 2527 - DNA, 42 bp, Artificial Sequence
  Description of Artificial Sequence: Synthetic oligonucleotide
attgtggaaaagatcctgcagtatcgcgagctgaccaagctg

SEQ ID NO: 2528 - DNA, 42 bp, Artificial Sequence
  Description of Artificial Sequence: Synthetic oligonucleotide
ccgcgtgaaatcaagaatgcgattgagaagagcgtgacggat

SEQ ID NO: 2529 - DNA, 42 bp, Artificial Sequence
  Description of Artificial Sequence: Synthetic oligonucleotide
accaatcgtgttgagctgctggcgaagaagattaccgacctg

SEQ ID NO: 2530 - DNA, 42 bp, Artificial Sequence
  Description of Artificial Sequence: Synthetic oligonucleotide
ccgcatgaattatctcgtgtggcggccacgctgcgtaagctg

SEQ ID NO: 2531 - DNA, 42 bp, Artificial Sequence
  Description of Artificial Sequence: Synthetic oligonucleotide
aaaggctataagttaattgcggaagttatcaccaaaacggat

SEQ ID NO: 2532 - DNA, 42 bp, Artificial Sequence
  Description of Artificial Sequence: Synthetic oligonucleotide
cgtgaaaccttagagattagctatcgcaacgcgattgcccgt

SEQ ID NO: 2533 - DNA, 42 bp, Artificial Sequence
  Description of Artificial Sequence: Synthetic oligonucleotide
gaagaaacccgcaacgcggtgtgggcggccatcaaagaactg

SEQ ID NO: 2534 - DNA, 42 bp, Artificial Sequence
  Description of Artificial Sequence: Synthetic oligonucleotide
gataatggcttaaaggtggaagtgcgctctattctggagaaa

SEQ ID NO: 2535 - DNA, 42 bp, Artificial Sequence
  Description of Artificial Sequence: Synthetic oligonucleotide
tttcagctggccacgaaaattatggataagttaattcgtgat

SEQ ID NO: 2536 - DNA, 42 bp, Artificial Sequence
  Description of Artificial Sequence: Synthetic oligonucleotide
ctgcgtgaaggtgttctggtgagcgaggttctgaaagagaat

SEQ ID NO: 2537 - DNA, 42 bp, Artificial Sequence
  Description of Artificial Sequence: Synthetic oligonucleotide
atgtataatggtgaccgtgcgcgtaagcaagtgctggttgat

SEQ ID NO: 2538 - DNA, 42 bp, Artificial Sequence
  Description of Artificial Sequence: Synthetic oligonucleotide
ctggatcaggccgagagcatttataaggccgcggcggagcgt

SEQ ID NO: 2539 - DNA, 42 bp, Artificial Sequence
  Description of Artificial Sequence: Synthetic oligonucleotide
cgtgaagaatggaagggtcaggcggaaacgaacaaaattctg

SEQ ID NO: 2540 - DNA, 42 bp, Artificial Sequence
  Description of Artificial Sequence: Synthetic oligonucleotide
ctgaaaagcttacaagtgcgtctggagttagcgcgtgagctg

SEQ ID NO: 2541 - DNA, 42 bp, Artificial Sequence
  Description of Artificial Sequence: Synthetic oligonucleotide
agcgaacaggttgttcatcagctggagcgcctgattgcccgt

SEQ ID NO: 2542 - DNA, 42 bp, Artificial Sequence
  Description of Artificial Sequence: Synthetic oligonucleotide
gaagcgatgtggcgtgagacgattgcgcgtgttcgcaccgaa

SEQ ID NO: 2543 - DNA, 42 bp, Artificial Sequence
  Description of Artificial Sequence: Synthetic oligonucleotide
aaaagcaccttagccgtggaactggagcaccagctggttcgt

SEQ ID NO: 2544 - DNA, 42 bp, Artificial Sequence
  Description of Artificial Sequence: Synthetic oligonucleotide
aatgaaccgcaccaacgtctggaatctttagtgaaatctaaa

SEQ ID NO: 2545 - DNA, 42 bp, Artificial Sequence
  Description of Artificial Sequence: Synthetic oligonucleotide
gcgtttaccaagtctgtggatgaattacgcgaaatggcgggc

SEQ ID NO: 2546 - DNA, 42 bp, Artificial Sequence
  Description of Artificial Sequence: Synthetic oligonucleotide
gcggaacgtatccgccagctggaaacggaggcgggcgagcgt

SEQ ID NO: 2547 - DNA, 42 bp, Artificial Sequence
  Description of Artificial Sequence: Synthetic oligonucleotide
gaagatgatgccatcgcgagcattcaccgcatttttaagaat

SEQ ID NO: 2548 - DNA, 42 bp, Artificial Sequence
  Description of Artificial Sequence: Synthetic oligonucleotide
cagctggatacggccgtggtgcgtgccttacgtgaacgcttt

SEQ ID NO: 2549 - DNA, 42 bp, Artificial Sequence
  Description of Artificial Sequence: Synthetic oligonucleotide
aaagaagcggagacgcgtgtgcgtgccttactgaaagagacc

SEQ ID NO: 2550 - DNA, 42 bp, Artificial Sequence
  Description of Artificial Sequence: Synthetic oligonucleotide
cgtgaactggcctctcagattcatcgcgagctgattaagatt

SEQ ID NO: 2551 - DNA, 42 bp, Artificial Sequence
  Description of Artificial Sequence: Synthetic oligonucleotide
ggcccggaagcctctgcgtttaaaaagaagatggtggaaaat

SEQ ID NO: 2552 - DNA, 42 bp, Artificial Sequence
  Description of Artificial Sequence: Synthetic oligonucleotide
cgtgaaggcttagagaaacattttcaagccattattgacagc

SEQ ID NO: 2553 - DNA, 42 bp, Artificial Sequence
  Description of Artificial Sequence: Synthetic oligonucleotide
aatgtgcgtgagttaaaaaatctgatcgagcgtgcggttatt

SEQ ID NO: 2554 - DNA, 42 bp, Artificial Sequence
  Description of Artificial Sequence: Synthetic oligonucleotide
attgaaaaagttggtaaaattctgacgacggcgcattgggat

SEQ ID NO: 2555 - DNA, 42 bp, Artificial Sequence
  Description of Artificial Sequence: Synthetic oligonucleotide
gaaaaagatgttgttcagattctgaaggccgtgagcgagttt

SEQ ID NO: 2556 - DNA, 42 bp, Artificial Sequence
  Description of Artificial Sequence: Synthetic oligonucleotide
gcggatagcgttgagccgatgtttcgtcacttaaaaaatacc

SEQ ID NO: 2557 - DNA, 42 bp, Artificial Sequence
  Description of Artificial Sequence: Synthetic oligonucleotide
aaaaaaaccttaaacgaaggcctgggtttactggaacgcgtg

SEQ ID NO: 2558 - DNA, 42 bp, Artificial Sequence
  Description of Artificial Sequence: Synthetic oligonucleotide
gaaaaaaccatccaatatgtgaaagaggccatgaaaaaacat

SEQ ID NO: 2559 - DNA, 42 bp, Artificial Sequence
  Description of Artificial Sequence: Synthetic oligonucleotide
aaaggcgaacgccaagatctggtggcctacctgaaatctgcg

SEQ ID NO: 2560 - DNA, 42 bp, Artificial Sequence
  Description of Artificial Sequence: Synthetic oligonucleotide
ccgcaggatgttgttcgtctggcgaactgggcccatgaacat

SEQ ID NO: 2561 - DNA, 42 bp, Artificial Sequence
  Description of Artificial Sequence: Synthetic oligonucleotide
gtgagcgatttaaagaaatatattgccgagctggaagttcag

SEQ ID NO: 2562 - DNA, 42 bp, Artificial Sequence
  Description of Artificial Sequence: Synthetic oligonucleotide
caggaagtggccaaggaactggcggagaacgcgcgtaagatt

SEQ ID NO: 2563 - DNA, 42 bp, Artificial Sequence
  Description of Artificial Sequence: Synthetic oligonucleotide
gaaaaaaatgttgccaaaatttttaagacggcgcgtgagctg

SEQ ID NO: 2564 - DNA, 42 bp, Artificial Sequence
  Description of Artificial Sequence: Synthetic oligonucleotide
accgaaaatgagaagtttctgggcaagttagtgcgtgacaaa

SEQ ID NO: 2565 - DNA, 42 bp, Artificial Sequence
  Description of Artificial Sequence: Synthetic oligonucleotide
gtgattggcaacgagaccaaaaaacaatacgaagcgttagaa

SEQ ID NO: 2566 - DNA, 42 bp, Artificial Sequence
  Description of Artificial Sequence: Synthetic oligonucleotide
accctgaaagccttacaggaactgatcgccgatgtgcgcgat

SEQ ID NO: 2567 - DNA, 42 bp, Artificial Sequence
  Description of Artificial Sequence: Synthetic oligonucleotide
agcaaagaagttttagtgcatgtgaagaacctggaaaagaat

SEQ ID NO: 2568 - DNA, 42 bp, Artificial Sequence
  Description of Artificial Sequence: Synthetic oligonucleotide
gatatttttaacaagaatatgcgtgcgcacgccctggaaaaa

SEQ ID NO: 2569 - DNA, 42 bp, Artificial Sequence
  Description of Artificial Sequence: Synthetic oligonucleotide
ccgaatatgaatgccgagcgtctgcagcgcacggcggatcgt

SEQ ID NO: 2570 - DNA, 42 bp, Artificial Sequence
  Description of Artificial Sequence: Synthetic oligonucleotide
accgataaattcatcgatgcggcgaagcaagtggtgcgcgcg

SEQ ID NO: 2571 - DNA, 42 bp, Artificial Sequence
  Description of Artificial Sequence: Synthetic oligonucleotide
accccgcaggttttcaaagaaattgaccgcctgcgtgagaat

SEQ ID NO: 2572 - DNA, 42 bp, Artificial Sequence
  Description of Artificial Sequence: Synthetic oligonucleotide
accgaaaaagttgtttttgaacagacgaaggtgattgccgat

SEQ ID NO: 2573 - DNA, 42 bp, Artificial Sequence
  Description of Artificial Sequence: Synthetic oligonucleotide
gatgcgcatcgccaaaatctggtgaactgggttgataaagtg

SEQ ID NO: 2574 - DNA, 42 bp, Artificial Sequence
  Description of Artificial Sequence: Synthetic oligonucleotide
gatgcgaatttcgagcgtgtgcgtatgttagccgatcagctg

SEQ ID NO: 2575 - DNA, 42 bp, Artificial Sequence
  Description of Artificial Sequence: Synthetic oligonucleotide
ggccgtgatttaacggattatctgatgaagatcctgaccgaa

SEQ ID NO: 2576 - DNA, 42 bp, Artificial Sequence
  Description of Artificial Sequence: Synthetic oligonucleotide
aaaagcaccaaccgcgattatctggccgagcgtctgcgcgaa

SEQ ID NO: 2577 - DNA, 42 bp, Artificial Sequence
  Description of Artificial Sequence: Synthetic oligonucleotide
ccggaagtggccaagcagtgggaacgtttagttcgtgcgacc

SEQ ID NO: 2578 - DNA, 42 bp, Artificial Sequence
  Description of Artificial Sequence: Synthetic oligonucleotide
aaaaatgcgcgcgaggattttctggacaacgcggcgtctctg

SEQ ID NO: 2579 - DNA, 42 bp, Artificial Sequence
  Description of Artificial Sequence: Synthetic oligonucleotide
ccgacccgtgacgccctggaaagcttattagcgaaattagat

SEQ ID NO: 2580 - DNA, 42 bp, Artificial Sequence
  Description of Artificial Sequence: Synthetic oligonucleotide
gtgggcgatttaatcaaagcgtatgacaaccagaaaaagctg

SEQ ID NO: 2581 - DNA, 42 bp, Artificial Sequence
  Description of Artificial Sequence: Synthetic oligonucleotide
caggaacatcgcgacctggcgcgtgaggccgcgcgtaagagc

SEQ ID NO: 2582 - DNA, 42 bp, Artificial Sequence
  Description of Artificial Sequence: Synthetic oligonucleotide
aattatcgtacgatcaccaaagcgatcatccgtcatgttgaa

SEQ ID NO: 2583 - DNA, 42 bp, Artificial Sequence
  Description of Artificial Sequence: Synthetic oligonucleotide
accgaacagaagaagcaggtgtttaaggttgcgaaagaggcg

SEQ ID NO: 2584 - DNA, 42 bp, Artificial Sequence
  Description of Artificial Sequence: Synthetic oligonucleotide
aaaaccgaagttaaggaaatgctgaatttagccgcgaaacat

SEQ ID NO: 2585 - DNA, 42 bp, Artificial Sequence
  Description of Artificial Sequence: Synthetic oligonucleotide
gaagaagtgaagaagaatgtgctgacgcaactgaatcgcgtg

SEQ ID NO: 2586 - DNA, 42 bp, Artificial Sequence
  Description of Artificial Sequence: Synthetic oligonucleotide
gtggaagaattcaagagcattattgttgacattcagcgcagc

SEQ ID NO: 2587 - DNA, 42 bp, Artificial Sequence
  Description of Artificial Sequence: Synthetic oligonucleotide
gcggcgaccttagaggaaaaactgaacaagatttttgagaaa

SEQ ID NO: 2588 - DNA, 42 bp, Artificial Sequence
  Description of Artificial Sequence: Synthetic oligonucleotide
gcgacccaggttttagcggaagtggaggaggcgaaaaaggcg

SEQ ID NO: 2589 - DNA, 42 bp, Artificial Sequence
  Description of Artificial Sequence: Synthetic oligonucleotide
gaaaatcgtttacgcgaaacccgtttaaacctgagccgcctg

SEQ ID NO: 2590 - DNA, 42 bp, Artificial Sequence
  Description of Artificial Sequence: Synthetic oligonucleotide
gaaaatctgggtgcccgtgtgaaagagttatatctgcaaaaa

SEQ ID NO: 2591 - DNA, 42 bp, Artificial Sequence
  Description of Artificial Sequence: Synthetic oligonucleotide
aaagcgaaagcccacaccattaccgttgaggcgcattctacc

SEQ ID NO: 2592 - DNA, 42 bp, Artificial Sequence
  Description of Artificial Sequence: Synthetic oligonucleotide
gaaagcgcgtacttagataatctgaagaaggaactggccaat

SEQ ID NO: 2593 - DNA, 42 bp, Artificial Sequence
  Description of Artificial Sequence: Synthetic oligonucleotide
accgaaatggcgaagaagattaccaaattagttaaagatagc

SEQ ID NO: 2594 - DNA, 42 bp, Artificial Sequence
  Description of Artificial Sequence: Synthetic oligonucleotide
cgtagcgatttacacgcgaccctggttgacgcggcgcgcgcg

SEQ ID NO: 2595 - DNA, 42 bp, Artificial Sequence
  Description of Artificial Sequence: Synthetic oligonucleotide
gatgaaattgtttctgcgcagaaaccattcgtggcgaagcat

SEQ ID NO: 2596 - DNA, 42 bp, Artificial Sequence
  Description of Artificial Sequence: Synthetic oligonucleotide
gatgatattgttgagcagcagaaaccaatcgcgattaagcat

SEQ ID NO: 2597 - DNA, 42 bp, Artificial Sequence
  Description of Artificial Sequence: Synthetic oligonucleotide
accgaagaaatgcgcgacctggtgcagcgcgagaccggcaaa

SEQ ID NO: 2598 - DNA, 42 bp, Artificial Sequence
  Description of Artificial Sequence: Synthetic oligonucleotide
gcggcggcggagaagcagcgtctggcctctctgctgaaggat

SEQ ID NO: 2599 - DNA, 42 bp, Artificial Sequence
  Description of Artificial Sequence: Synthetic oligonucleotide
aaaaaacagttagaggatgtgtttgttttactgaatgagaat

SEQ ID NO: 2600 - DNA, 42 bp, Artificial Sequence
  Description of Artificial Sequence: Synthetic oligonucleotide
accgaatatgttgacgcgctgaaaaagttacagatgctgcat

SEQ ID NO: 2601 - DNA, 42 bp, Artificial Sequence
  Description of Artificial Sequence: Synthetic oligonucleotide
aaaagcagcgttgccatgctggtggaacgcaagctgctggaa

SEQ ID NO: 2602 - DNA, 42 bp, Artificial Sequence
  Description of Artificial Sequence: Synthetic oligonucleotide
gcgaaagtgtctgaggcgctggaaaagcgctatagcatgacc

SEQ ID NO: 2603 - DNA, 42 bp, Artificial Sequence
  Description of Artificial Sequence: Synthetic oligonucleotide
ggcgaaaaattatacaccggcctgcgcgaggtggtgacggaa

SEQ ID NO: 2604 - DNA, 42 bp, Artificial Sequence
  Description of Artificial Sequence: Synthetic oligonucleotide
ggcgaaagcttaaagaatctgattgacttccatattaaccat

SEQ ID NO: 2605 - DNA, 42 bp, Artificial Sequence
  Description of Artificial Sequence: Synthetic oligonucleotide
cagctggaattacgcgatgcggtggagcacgcgcgtacgacc

SEQ ID NO: 2606 - DNA, 42 bp, Artificial Sequence
  Description of Artificial Sequence: Synthetic oligonucleotide
gcggcgattacgcacaccgcgcgtatggccgacaaactgcgt

SEQ ID NO: 2607 - DNA, 42 bp, Artificial Sequence
  Description of Artificial Sequence: Synthetic oligonucleotide
gaaaatgcgcgcaagtatgtggaacgcgttagcgaattaacc

SEQ ID NO: 2608 - DNA, 42 bp, Artificial Sequence
  Description of Artificial Sequence: Synthetic oligonucleotide
ctgaccgaagttcaaaccattgtggagcaagtgaaagagaaa

SEQ ID NO: 2609 - DNA, 42 bp, Artificial Sequence
  Description of Artificial Sequence: Synthetic oligonucleotide
gaaatgcgtaagggtattgatctggccacgaccctggagcgt

SEQ ID NO: 2610 - DNA, 42 bp, Artificial Sequence
  Description of Artificial Sequence: Synthetic oligonucleotide
ctgacccgtgccgccgtggaactggccaaggaatggcgtacc

SEQ ID NO: 2611 - DNA, 42 bp, Artificial Sequence
  Description of Artificial Sequence: Synthetic oligonucleotide
cgtcagaccgaggaccagctgaaaaagttaaaaggctacacc

SEQ ID NO: 2612 - DNA, 42 bp, Artificial Sequence
  Description of Artificial Sequence: Synthetic oligonucleotide
gatcagcagcgcgactttcagcgtgagatccagattttaaaa

SEQ ID NO: 2613 - DNA, 42 bp, Artificial Sequence
  Description of Artificial Sequence: Synthetic oligonucleotide
gcggataaattattaaccctggaagttaagagcctggacacc

SEQ ID NO: 2614 - DNA, 42 bp, Artificial Sequence
  Description of Artificial Sequence: Synthetic oligonucleotide
ctggaagcggcccgccagtttagcgaggccgtgaaagccgaa

SEQ ID NO: 2615 - DNA, 42 bp, Artificial Sequence
  Description of Artificial Sequence: Synthetic oligonucleotide
agccgtgtggccgactatcgtgataacatggccaaacagacc

SEQ ID NO: 2616 - DNA, 42 bp, Artificial Sequence
  Description of Artificial Sequence: Synthetic oligonucleotide
gatcataccaagaaggcggtgctggaggccaaagaaaagacc

SEQ ID NO: 2617 - DNA, 42 bp, Artificial Sequence
  Description of Artificial Sequence: Synthetic oligonucleotide
gaacgtggcaagaagcaggcgaaattattagcgcaggagctg

SEQ ID NO: 2618 - DNA, 42 bp, Artificial Sequence
  Description of Artificial Sequence: Synthetic oligonucleotide
accgaagaattagttcagaaaattaaggccattaaagaggtg

SEQ ID NO: 2619 - DNA, 42 bp, Artificial Sequence
  Description of Artificial Sequence: Synthetic oligonucleotide
ctgctgaaatctgccgtggaactggccaaggattggcgtacc

SEQ ID NO: 2620 - DNA, 42 bp, Artificial Sequence
  Description of Artificial Sequence: Synthetic oligonucleotide
ccggaacgtacggaggtgctgggccgcgccgcggaagccacc

SEQ ID NO: 2621 - DNA, 42 bp, Artificial Sequence
  Description of Artificial Sequence: Synthetic oligonucleotide
ctgaccaatcaccaaaaatttgcgaaggccaatgtgcgcgaa

SEQ ID NO: 2622 - DNA, 42 bp, Artificial Sequence
  Description of Artificial Sequence: Synthetic oligonucleotide
caggtgcgtacggaggaactgctgacgggtcgtgcgttagaa

SEQ ID NO: 2623 - DNA, 42 bp, Artificial Sequence
  Description of Artificial Sequence: Synthetic oligonucleotide
ctggaaaatgttttagaagcggcgcgccacctgcatcaaacc

SEQ ID NO: 2624 - DNA, 42 bp, Artificial Sequence
  Description of Artificial Sequence: Synthetic oligonucleotide
ccgcgtgatgttgccgtgagcagcttccaccatgcgcgcctg

SEQ ID NO: 2625 - DNA, 42 bp, Artificial Sequence
  Description of Artificial Sequence: Synthetic oligonucleotide
gatgaaaccttattcaaaaccctggttaaggcgaaagagctg

SEQ ID NO: 2626 - DNA, 42 bp, Artificial Sequence
  Description of Artificial Sequence: Synthetic oligonucleotide
ccgaaagtgatccaccaggcgctggaggacaaaattgcccag

SEQ ID NO: 2627 - DNA, 42 bp, Artificial Sequence
  Description of Artificial Sequence: Synthetic oligonucleotide
cgtgaacaggccgagcaggtgctgcgcgttgcgctgaagcat

SEQ ID NO: 2628 - DNA, 42 bp, Artificial Sequence
  Description of Artificial Sequence: Synthetic oligonucleotide
gatggcgaaatgtaccaaaccctgcgtttagccaaagaactg

SEQ ID NO: 2629 - DNA, 42 bp, Artificial Sequence
  Description of Artificial Sequence: Synthetic oligonucleotide
gatcatggcaagacgaccctgagcaaggttctgaccgagatt

SEQ ID NO: 2630 - DNA, 42 bp, Artificial Sequence
  Description of Artificial Sequence: Synthetic oligonucleotide
cgtgcggaagttgccatgatgctgaatgatcgcaaccgtgaa

SEQ ID NO: 2631 - DNA, 42 bp, Artificial Sequence
  Description of Artificial Sequence: Synthetic oligonucleotide
ccggatgaagccgcccgtcaggcgttagagaaacagcgcgaa

SEQ ID NO: 2632 - DNA, 42 bp, Artificial Sequence
  Description of Artificial Sequence: Synthetic oligonucleotide
gataccctgcaagcccgtgcgatgctggacatcgtgaaacgt

SEQ ID NO: 2633 - DNA, 42 bp, Artificial Sequence
  Description of Artificial Sequence: Synthetic oligonucleotide
caggtgcgtttagagcgtattctggacgagattagcaaggaa

SEQ ID NO: 2634 - DNA, 42 bp, Artificial Sequence
  Description of Artificial Sequence: Synthetic oligonucleotide
ctggcgaccaagttatttgataatttagagcgtgtgaaggaa

SEQ ID NO: 2635 - DNA, 42 bp, Artificial Sequence
  Description of Artificial Sequence: Synthetic oligonucleotide
ccgcgtaccttaaacgcgtgggtgaaagttgttgaagaaaaa

SEQ ID NO: 2636 - DNA, 42 bp, Artificial Sequence
  Description of Artificial Sequence: Synthetic oligonucleotide
agcgcggcggagcgcgaactgattggtcgctttcaggaccgt

SEQ ID NO: 2637 - DNA, 42 bp, Artificial Sequence
  Description of Artificial Sequence: Synthetic oligonucleotide
aaagcgctggacaaggtggaaaaagttttagtgagcgcccag

SEQ ID NO: 2638 - DNA, 42 bp, Artificial Sequence
  Description of Artificial Sequence: Synthetic oligonucleotide
cgtaaacagttacaccagctggtggacttcgcgaaaacgaat

SEQ ID NO: 2639 - DNA, 42 bp, Artificial Sequence
  Description of Artificial Sequence: Synthetic oligonucleotide
ctggaagaagccgttaatgcggaagcccgcaaaattgccaat

SEQ ID NO: 2640 - DNA, 42 bp, Artificial Sequence
  Description of Artificial Sequence: Synthetic oligonucleotide
gcggaaagcgttgagcaggcgattgccgcccgtgaacaccgt

SEQ ID NO: 2641 - DNA, 42 bp, Artificial Sequence
  Description of Artificial Sequence: Synthetic oligonucleotide
gatgaacagcgcaagctgctgaaagaggcccaggcggagcat

SEQ ID NO: 2642 - DNA, 42 bp, Artificial Sequence
  Description of Artificial Sequence: Synthetic oligonucleotide
tttaaagaaatctctgatgatgtgaaggagaaaaataagaat

SEQ ID NO: 2643 - DNA, 42 bp, Artificial Sequence
  Description of Artificial Sequence: Synthetic oligonucleotide
gtggaaaaagttttaaaaacccgttaccacgatgcgacgagc

SEQ ID NO: 2644 - DNA, 42 bp, Artificial Sequence
  Description of Artificial Sequence: Synthetic oligonucleotide
cgtgaaaccttattaaccatggcggaacgcgcccgtgcggcg

SEQ ID NO: 2645 - DNA, 42 bp, Artificial Sequence
  Description of Artificial Sequence: Synthetic oligonucleotide
gcggataaagtttacaaaaccctgcaacgcctgcgtgacctg

SEQ ID NO: 2646 - DNA, 42 bp, Artificial Sequence
  Description of Artificial Sequence: Synthetic oligonucleotide
ccggatgatcaacaaaaagaagtggttaacatggcgcagaaa

SEQ ID NO: 2647 - DNA, 42 bp, Artificial Sequence
  Description of Artificial Sequence: Synthetic oligonucleotide
gtggaacgtatcttcagcattgtggagcaacgtctggaggcg

SEQ ID NO: 2648 - DNA, 42 bp, Artificial Sequence
  Description of Artificial Sequence: Synthetic oligonucleotide
tttgatgatgttacggatctgctgcgcaagaccctggttagc

SEQ ID NO: 2649 - DNA, 42 bp, Artificial Sequence
  Description of Artificial Sequence: Synthetic oligonucleotide
gaacgtgaagcctctgatattattaacaacctgcgtaacttt

SEQ ID NO: 2650 - DNA, 42 bp, Artificial Sequence
  Description of Artificial Sequence: Synthetic oligonucleotide
tgggataccttagaggcggtggtgaaggagaaactggccagc

SEQ ID NO: 2651 - DNA, 42 bp, Artificial Sequence
  Description of Artificial Sequence: Synthetic oligonucleotide
gcggatgcgcactctaatctggcgtctatccataaagacagc

SEQ ID NO: 2652 - DNA, 42 bp, Artificial Sequence
  Description of Artificial Sequence: Synthetic oligonucleotide
gaagcgagcgttcgcctggcggaacgcttagcgaaacaagcg

SEQ ID NO: 2653 - DNA, 42 bp, Artificial Sequence
  Description of Artificial Sequence: Synthetic oligonucleotide
gcggcgattaaggccaaagatgatttccaaatggaaattacc

SEQ ID NO: 2654 - DNA, 42 bp, Artificial Sequence
  Description of Artificial Sequence: Synthetic oligonucleotide
aaagaagcggccacggcggtggcgaaggcctttgaacaagaa

SEQ ID NO: 2655 - DNA, 42 bp, Artificial Sequence
  Description of Artificial Sequence: Synthetic oligonucleotide
tataaaaaacgcttaaatgaactgatcacggatgcgttaatt

SEQ ID NO: 2656 - DNA, 42 bp, Artificial Sequence
  Description of Artificial Sequence: Synthetic oligonucleotide
ggcgaagtggcccaaattattcgtaaggttggcacccgcgaa

SEQ ID NO: 2657 - DNA, 42 bp, Artificial Sequence
  Description of Artificial Sequence: Synthetic oligonucleotide
gaagtggaaaagaacctggtgcgtgaggccgtgaaaaagagc

SEQ ID NO: 2658 - DNA, 42 bp, Artificial Sequence
  Description of Artificial Sequence: Synthetic oligonucleotide
aaactggaacgcgagcgtatgcagaatgagtacgcgaaaagc

SEQ ID NO: 2659 - DNA, 42 bp, Artificial Sequence
  Description of Artificial Sequence: Synthetic oligonucleotide
gaaagcgatttaaagcgtattggcgccatccattttaagacc

SEQ ID NO: 2660 - DNA, 42 bp, Artificial Sequence
  Description of Artificial Sequence: Synthetic oligonucleotide
gataatcagatcggtgaagtggtgaagggttttgaaaagaaa

SEQ ID NO: 2661 - DNA, 42 bp, Artificial Sequence
  Description of Artificial Sequence: Synthetic oligonucleotide
tataatgatgagaagaaactggcgtctaacgaaattgccaat

SEQ ID NO: 2662 - DNA, 42 bp, Artificial Sequence
  Description of Artificial Sequence: Synthetic oligonucleotide
attaccaaacacatggagcgttatctggacatcctgaatagc

SEQ ID NO: 2663 - DNA, 42 bp, Artificial Sequence
  Description of Artificial Sequence: Synthetic oligonucleotide
tttaatcgtgacatccagctgctgaaggccctggataacgaa

SEQ ID NO: 2664 - DNA, 42 bp, Artificial Sequence
  Description of Artificial Sequence: Synthetic oligonucleotide
attctggaagcccaaaaaattaaaaagttagcggattctgcg

SEQ ID NO: 2665 - DNA, 42 bp, Artificial Sequence
  Description of Artificial Sequence: Synthetic oligonucleotide
aaagaaacccaacaacgtcagattgacttatttaccaaggtg

SEQ ID NO: 2666 - DNA, 42 bp, Artificial Sequence
  Description of Artificial Sequence: Synthetic oligonucleotide
gatgcgagcgaggttaccattcgtaaggccattgcgcgcttt

SEQ ID NO: 2667 - DNA, 42 bp, Artificial Sequence
  Description of Artificial Sequence: Synthetic oligonucleotide
gtgcaggaagcccaaggcaaatggccggccttaaaagaaaaa

SEQ ID NO: 2668 - DNA, 42 bp, Artificial Sequence
  Description of Artificial Sequence: Synthetic oligonucleotide
ctgggcaaaacgttagatgatcaggagcgcaaaattgccaat

SEQ ID NO: 2669 - DNA, 42 bp, Artificial Sequence
  Description of Artificial Sequence: Synthetic oligonucleotide
ctgaccaaagccgccgtggaactggccaaggattggcgtacc

SEQ ID NO: 2670 - DNA, 42 bp, Artificial Sequence
  Description of Artificial Sequence: Synthetic oligonucleotide
gattatcgtggtggtcagctggcggccaagcatctgcaagaa

SEQ ID NO: 2671 - DNA, 42 bp, Artificial Sequence
  Description of Artificial Sequence: Synthetic oligonucleotide
gtggaaggcatcttcaatgatgtggttgagaatgtgaagcgt

SEQ ID NO: 2672 - DNA, 42 bp, Artificial Sequence
  Description of Artificial Sequence: Synthetic oligonucleotide
ccggaagataagtctcgtattgtgtctgagctgaaagacaaa

SEQ ID NO: 2673 - DNA, 42 bp, Artificial Sequence
  Description of Artificial Sequence: Synthetic oligonucleotide
gaagtgaccgttcgcaatcgttataaggagctggtggagaaa

SEQ ID NO: 2674 - DNA, 42 bp, Artificial Sequence
  Description of Artificial Sequence: Synthetic oligonucleotide
aaaattgtgcaagagcgtctggaaaaggttattgcgtctgcg

SEQ ID NO: 2675 - DNA, 42 bp, Artificial Sequence
  Description of Artificial Sequence: Synthetic oligonucleotide
catgaagcgttccaaaatcgtgtgaacgagctggcggccaaa

SEQ ID NO: 2676 - DNA, 42 bp, Artificial Sequence
  Description of Artificial Sequence: Synthetic oligonucleotide
gcggaacatcgcacgctggcgcgtgaggccgtgcgtaagagc

SEQ ID NO: 2677 - DNA, 42 bp, Artificial Sequence
  Description of Artificial Sequence: Synthetic oligonucleotide
ccgccggatcacacgcgtctgcgtggtttagtgagcaaggcg

SEQ ID NO: 2678 - DNA, 42 bp, Artificial Sequence
  Description of Artificial Sequence: Synthetic oligonucleotide
acccgtgaattattcgaaggcgcggttcgccagattcgcctg

SEQ ID NO: 2679 - DNA, 42 bp, Artificial Sequence
  Description of Artificial Sequence: Synthetic oligonucleotide
gaaaaaaccgttgaggcgtttgcggaggccgtgaaaacggtg

SEQ ID NO: 2680 - DNA, 42 bp, Artificial Sequence
  Description of Artificial Sequence: Synthetic oligonucleotide
agcgatctggttgaccagggcaaagagcgcctgaatcgcctg

SEQ ID NO: 2681 - DNA, 42 bp, Artificial Sequence
  Description of Artificial Sequence: Synthetic oligonucleotide
accgatgtggacgccgcgaatctgcgcgagacctttcgcaat

SEQ ID NO: 2682 - DNA, 42 bp, Artificial Sequence
  Description of Artificial Sequence: Synthetic oligonucleotide
atgcgtgaacgcatcgaatttctgaacgaggcgagcgttatg

SEQ ID NO: 2683 - DNA, 42 bp, Artificial Sequence
  Description of Artificial Sequence: Synthetic oligonucleotide
gaaaaagatcgcaacgatctgattacgtacctgaaaaaggcg

SEQ ID NO: 2684 - DNA, 42 bp, Artificial Sequence
  Description of Artificial Sequence: Synthetic oligonucleotide
aaaagcaccgttttagcgaaagtgaaggagattctggacaat

SEQ ID NO: 2685 - DNA, 42 bp, Artificial Sequence
  Description of Artificial Sequence: Synthetic oligonucleotide
ctgaccccgcgcaagcgtctgaaagagtctctggatcaaatt

SEQ ID NO: 2686 - DNA, 42 bp, Artificial Sequence
  Description of Artificial Sequence: Synthetic oligonucleotide
gaagaaaccacggccaaactgatttactctaaagtgcgcacc

SEQ ID NO: 2687 - DNA, 42 bp, Artificial Sequence
  Description of Artificial Sequence: Synthetic oligonucleotide
gatcgtgtgcgcgagagcctgtttaacatcgtgaccgcccgt

SEQ ID NO: 2688 - DNA, 42 bp, Artificial Sequence
  Description of Artificial Sequence: Synthetic oligonucleotide
gatgtgaccttattaaaaaccctggacaaggcggtgaagacc

SEQ ID NO: 2689 - DNA, 42 bp, Artificial Sequence
  Description of Artificial Sequence: Synthetic oligonucleotide
gaaaaaaccgttgagctgctgcgtaacgttctgaaagagagc

SEQ ID NO: 2690 - DNA, 42 bp, Artificial Sequence
  Description of Artificial Sequence: Synthetic oligonucleotide
ggcagcaaagagatcgataccgtgatcgagctgaaaaagcat

SEQ ID NO: 2691 - DNA, 42 bp, Artificial Sequence
  Description of Artificial Sequence: Synthetic oligonucleotide
cgtgcggtgaacaacgaatatgtgaaggttatgcgtgaaaaa

SEQ ID NO: 2692 - DNA, 42 bp, Artificial Sequence
  Description of Artificial Sequence: Synthetic oligonucleotide
gaaattacctctaagaaaattgcgcgcgagcgtattgacgcg

SEQ ID NO: 2693 - DNA, 42 bp, Artificial Sequence
  Description of Artificial Sequence: Synthetic oligonucleotide
gaagatatttctaagaaaattgcgcaagagcgtatggatgcg

SEQ ID NO: 2694 - DNA, 42 bp, Artificial Sequence
  Description of Artificial Sequence: Synthetic oligonucleotide
tggggcgtgacgaaggcggcggaaaagcaaatgaaagataaa

SEQ ID NO: 2695 - DNA, 42 bp, Artificial Sequence
  Description of Artificial Sequence: Synthetic oligonucleotide
agcgatctggtttacgaaaccattaaccgcgtgaaacgcatt

SEQ ID NO: 2696 - DNA, 42 bp, Artificial Sequence
  Description of Artificial Sequence: Synthetic oligonucleotide
ccgaaagaaatccaaattcagattcgcaagtttgtgggtgaa

SEQ ID NO: 2697 - DNA, 42 bp, Artificial Sequence
  Description of Artificial Sequence: Synthetic oligonucleotide
gaaaaagatcgcaacgatagcattacgtacctgaaaaaggcg

SEQ ID NO: 2698 - DNA, 42 bp, Artificial Sequence
  Description of Artificial Sequence: Synthetic oligonucleotide
accagcgtgaaggttaaagaagcggttgaggcggtgcgcgat

SEQ ID NO: 2699 - DNA, 42 bp, Artificial Sequence
  Description of Artificial Sequence: Synthetic oligonucleotide
accagcgcggtttacaatgaactggaccgcctgcgtgaggtg

SEQ ID NO: 2700 - DNA, 42 bp, Artificial Sequence
  Description of Artificial Sequence: Synthetic oligonucleotide
gataaagtggccttaaattggctgaaaggtttaaaagaaaat

SEQ ID NO: 2701 - DNA, 42 bp, Artificial Sequence
  Description of Artificial Sequence: Synthetic oligonucleotide
aatcgtatgattgactctgtgctggaatctgcccgtgatatg

SEQ ID NO: 2702 - DNA, 42 bp, Artificial Sequence
  Description of Artificial Sequence: Synthetic oligonucleotide
ctgagcgtgatgaaggagacctatgaaacggttatgaaaaaa

SEQ ID NO: 2703 - DNA, 42 bp, Artificial Sequence
  Description of Artificial Sequence: Synthetic oligonucleotide
ctgtatcagcgcatcgcgaaaattgtttctattgatgacgat

SEQ ID NO: 2704 - DNA, 42 bp, Artificial Sequence
  Description of Artificial Sequence: Synthetic oligonucleotide
gaagaaacccaacgcacctttctgaaggaggtgaaagttatg

SEQ ID NO: 2705 - DNA, 42 bp, Artificial Sequence
  Description of Artificial Sequence: Synthetic oligonucleotide
ccggaaaccgccgagaccctgtataaggagattcgtaaggtg

SEQ ID NO: 2706 - DNA, 42 bp, Artificial Sequence
  Description of Artificial Sequence: Synthetic oligonucleotide
ctggatgcggttcgcaccctgaaaacggttattgatgagaaa

SEQ ID NO: 2707 - DNA, 42 bp, Artificial Sequence
  Description of Artificial Sequence: Synthetic oligonucleotide
cgtaccgcggttaagaaagtgattgaccaactgaaattagaa

SEQ ID NO: 2708 - DNA, 42 bp, Artificial Sequence
  Description of Artificial Sequence: Synthetic oligonucleotide
ccggcgcgtgttgttcagctgtttcgcgacgtggaacaaaaa

SEQ ID NO: 2709 - DNA, 42 bp, Artificial Sequence
  Description of Artificial Sequence: Synthetic oligonucleotide
catagcgaaacggttgcgaaacatggtgccaaactgtctgcg

SEQ ID NO: 2710 - DNA, 42 bp, Artificial Sequence
  Description of Artificial Sequence: Synthetic oligonucleotide
agcgcgcatttagaccgtctgcagaaggccgcggataagatt

SEQ ID NO: 2711 - DNA, 42 bp, Artificial Sequence
  Description of Artificial Sequence: Synthetic oligonucleotide
ggcaaaaccttagacaccgcgaaagccgttgcggatgagctg

SEQ ID NO: 2712 - DNA, 42 bp, Artificial Sequence
  Description of Artificial Sequence: Synthetic oligonucleotide
gaaagcatgaataaggagctgaaaaaaatcatcggccaggtg

SEQ ID NO: 2713 - DNA, 42 bp, Artificial Sequence
  Description of Artificial Sequence: Synthetic oligonucleotide
catgataaagccatcgaagcgtatgagaagaccatttctatt

SEQ ID NO: 2714 - DNA, 42 bp, Artificial Sequence
  Description of Artificial Sequence: Synthetic oligonucleotide
ctggataccgttcgcgaagaagtgaagacgctgaaagagcgt

SEQ ID NO: 2715 - DNA, 42 bp, Artificial Sequence
  Description of Artificial Sequence: Synthetic oligonucleotide
aataatcgtatggagttaaaagcggcgatcgagggcctgaaa

SEQ ID NO: 2716 - DNA, 42 bp, Artificial Sequence
  Description of Artificial Sequence: Synthetic oligonucleotide
aaaaatgtggccgccgcggaacgtcaattacgtgaattagaa

SEQ ID NO: 2717 - DNA, 42 bp, Artificial Sequence
  Description of Artificial Sequence: Synthetic oligonucleotide
ctgaccgaaacggttggcgaactggttcgcgtggcggagcgt

SEQ ID NO: 2718 - DNA, 42 bp, Artificial Sequence
  Description of Artificial Sequence: Synthetic oligonucleotide
gatatgtgggtgacgatcgataaacgtatggccgagattacc

SEQ ID NO: 2719 - DNA, 42 bp, Artificial Sequence
  Description of Artificial Sequence: Synthetic oligonucleotide
ccgctgaaaacggcccatgatgtgcgcgttacctttgcccgt

SEQ ID NO: 2720 - DNA, 42 bp, Artificial Sequence
  Description of Artificial Sequence: Synthetic oligonucleotide
ccgcatgatacgttaaatcgtattaagaagtatctgttaacc

SEQ ID NO: 2721 - DNA, 42 bp, Artificial Sequence
  Description of Artificial Sequence: Synthetic oligonucleotide
gaaaataccgccatccatcattatttagaggcgctgaaggtg

SEQ ID NO: 2722 - DNA, 42 bp, Artificial Sequence
  Description of Artificial Sequence: Synthetic oligonucleotide
attggcgatacggccaaaaaactgggtgagatgtggagcgaa

SEQ ID NO: 2723 - DNA, 42 bp, Artificial Sequence
  Description of Artificial Sequence: Synthetic oligonucleotide
agcctggataaggccaaagcgctgaaggagcagctggagaaa

SEQ ID NO: 2724 - DNA, 42 bp, Artificial Sequence
  Description of Artificial Sequence: Synthetic oligonucleotide
gcgcgtcaggacttccagcgtgaagccgagctgctgacgatg

SEQ ID NO: 2725 - DNA, 42 bp, Artificial Sequence
  Description of Artificial Sequence: Synthetic oligonucleotide
tttcgtgatttagccctgcgtgtggaccaaattcgtgaccag

SEQ ID NO: 2726 - DNA, 42 bp, Artificial Sequence
  Description of Artificial Sequence: Synthetic oligonucleotide
catgatattaaggaggattttagcaacttaattcgtacgctg

SEQ ID NO: 2727 - DNA, 42 bp, Artificial Sequence
  Description of Artificial Sequence: Synthetic oligonucleotide
gaacgtacccgcaagaccggcgaagccttcgcggcgggtctg

SEQ ID NO: 2728 - DNA, 42 bp, Artificial Sequence
  Description of Artificial Sequence: Synthetic oligonucleotide
ccgcatcagttacgccatagctttgccacgcatatgctggaa

SEQ ID NO: 2729 - DNA, 42 bp, Artificial Sequence
  Description of Artificial Sequence: Synthetic oligonucleotide
aaaaccctggccggtcagctgcattctgagctgaaagagttt

SEQ ID NO: 2730 - DNA, 42 bp, Artificial Sequence
  Description of Artificial Sequence: Synthetic oligonucleotide
ctgtatgatgccttagaaaaagcgcgcgacctgctgaacaat

SEQ ID NO: 2731 - DNA, 42 bp, Artificial Sequence
  Description of Artificial Sequence: Synthetic oligonucleotide
tggcgtgcggccatgcgcaaagcggatacggccctgagcgaa

SEQ ID NO: 2732 - DNA, 42 bp, Artificial Sequence
  Description of Artificial Sequence: Synthetic oligonucleotide
gatgaaaccttattcaaaaccctgatccgcgcgaaagagctg

SEQ ID NO: 2733 - DNA, 42 bp, Artificial Sequence
  Description of Artificial Sequence: Synthetic oligonucleotide
gtgcaggaaggtgttgataaaattcgccactttcaggagctg

SEQ ID NO: 2734 - DNA, 42 bp, Artificial Sequence
  Description of Artificial Sequence: Synthetic oligonucleotide
cgtgaagcgcacgagaccctggcgatcgccatgaatcgtctg

SEQ ID NO: 2735 - DNA, 42 bp, Artificial Sequence
  Description of Artificial Sequence: Synthetic oligonucleotide
accgatcagttagttcgttttattgacgaggcgcatcgcgcg

SEQ ID NO: 2736 - DNA, 42 bp, Artificial Sequence
  Description of Artificial Sequence: Synthetic oligonucleotide
gatcaggaacgccaagtgtttcagaaggccctgggcaagctg

SEQ ID NO: 2737 - DNA, 42 bp, Artificial Sequence
  Description of Artificial Sequence: Synthetic oligonucleotide
aaaacccatttattacaggcggcgggtaacgaagcgaagaaa

SEQ ID NO: 2738 - DNA, 42 bp, Artificial Sequence
  Description of Artificial Sequence: Synthetic oligonucleotide
catgaatttttatctaaagtgagccaccgcattgtgaacgaa

SEQ ID NO: 2739 - DNA, 42 bp, Artificial Sequence
  Description of Artificial Sequence: Synthetic oligonucleotide
gataccatgaaacaagcctttgatcgtatgacgaagctgcgt

SEQ ID NO: 2740 - DNA, 42 bp, Artificial Sequence
  Description of Artificial Sequence: Synthetic oligonucleotide
ctggaagaattattcagcaaaattaagaacaccctgaaggtg

SEQ ID NO: 2741 - DNA, 42 bp, Artificial Sequence
  Description of Artificial Sequence: Synthetic oligonucleotide
gatattgtgcgcgagcgtgcgattaagttcctgagcacgaaa

SEQ ID NO: 2742 - DNA, 42 bp, Artificial Sequence
  Description of Artificial Sequence: Synthetic oligonucleotide
gtgaccaaaatcaaggaagtgcagcgcatcgcggtggaggaa

SEQ ID NO: 2743 - DNA, 42 bp, Artificial Sequence
  Description of Artificial Sequence: Synthetic oligonucleotide
cgtgcgagcttaaagaaactgattgactaccatgtggccagc

SEQ ID NO: 2744 - DNA, 42 bp, Artificial Sequence
  Description of Artificial Sequence: Synthetic oligonucleotide
ccggcggaattcgttgatattaaacaccgcctgacccaaatt

SEQ ID NO: 2745 - DNA, 42 bp, Artificial Sequence
  Description of Artificial Sequence: Synthetic oligonucleotide
ctgcgtgatatcgttcgtgcgaatgagcgcggcattcaagcg

SEQ ID NO: 2746 - DNA, 42 bp, Artificial Sequence
  Description of Artificial Sequence: Synthetic oligonucleotide
ctgggcccgcacgaggcgaatctgttcgacatgcgtcagaaa

SEQ ID NO: 2747 - DNA, 42 bp, Artificial Sequence
  Description of Artificial Sequence: Synthetic oligonucleotide
ccgattaaacacgttagcctgatggatcaacgcgcgcgtcag

SEQ ID NO: 2748 - DNA, 42 bp, Artificial Sequence
  Description of Artificial Sequence: Synthetic oligonucleotide
gatctgctgaagcacaccaccaatgttgttaaagcgcacacc

SEQ ID NO: 2749 - DNA, 42 bp, Artificial Sequence
  Description of Artificial Sequence: Synthetic oligonucleotide
aatgaaacccgcgagaaactgcatcaattagaaaaatctctg

SEQ ID NO: 2750 - DNA, 42 bp, Artificial Sequence
  Description of Artificial Sequence: Synthetic oligonucleotide
gataaagtgcgcgagaaaattaccttagttgaagaaaagacc

SEQ ID NO: 2751 - DNA, 42 bp, Artificial Sequence
  Description of Artificial Sequence: Synthetic oligonucleotide
agcgaagtgcgcgagcagattaatgccaaggtggcggagtgg

SEQ ID NO: 2752 - DNA, 42 bp, Artificial Sequence
  Description of Artificial Sequence: Synthetic oligonucleotide
cgtaaaattacggacgatctggtgaagaacgtggaaaagctg

SEQ ID NO: 2753 - DNA, 42 bp, Artificial Sequence
  Description of Artificial Sequence: Synthetic oligonucleotide
aatcagctggactctcagcgtctgaaggagcgtctgtacaat

SEQ ID NO: 2754 - DNA, 42 bp, Artificial Sequence
  Description of Artificial Sequence: Synthetic oligonucleotide
aaaaaagaattagaggtgctgagccaaaagctgcgtgccctg

SEQ ID NO: 2755 - DNA, 42 bp, Artificial Sequence
  Description of Artificial Sequence: Synthetic oligonucleotide
accgcgctggccgacaccggcgcgaagttacatgataagtat

SEQ ID NO: 2756 - DNA, 42 bp, Artificial Sequence
  Description of Artificial Sequence: Synthetic oligonucleotide
gaagtgattgacaagattcagaaaaagacgcgtgaattcctg

SEQ ID NO: 2757 - DNA, 42 bp, Artificial Sequence
  Description of Artificial Sequence: Synthetic oligonucleotide
ccgcaggaaaaggacattagcagcaagttactgaaagccctg

SEQ ID NO: 2758 - DNA, 42 bp, Artificial Sequence
  Description of Artificial Sequence: Synthetic oligonucleotide
ccgtatagctctcgcctgaaaaaaatcggtgaactgttagat

SEQ ID NO: 2759 - DNA, 42 bp, Artificial Sequence
  Description of Artificial Sequence: Synthetic oligonucleotide
ccgtatagctctcgcctgaaaaaagttggtgaactgttagat

SEQ ID NO: 2760 - DNA, 42 bp, Artificial Sequence
  Description of Artificial Sequence: Synthetic oligonucleotide
cgtgcgaaagttttaggcgcgcgtaacttacatgaattaacc

SEQ ID NO: 2761 - DNA, 42 bp, Artificial Sequence
  Description of Artificial Sequence: Synthetic oligonucleotide
aaagaactgcacacggaactggaacaagccggccgtttcgtg

SEQ ID NO: 2762 - DNA, 42 bp, Artificial Sequence
  Description of Artificial Sequence: Synthetic oligonucleotide
gaaagcgtgcgcgacgcgctggtgcgcgcccaggattacatt

SEQ ID NO: 2763 - DNA, 42 bp, Artificial Sequence
  Description of Artificial Sequence: Synthetic oligonucleotide
gatcagctgcgcgccggctatgtggcccgcgcgagcgagcgt

SEQ ID NO: 2764 - DNA, 42 bp, Artificial Sequence
  Description of Artificial Sequence: Synthetic oligonucleotide
agcgaaggcttaaagagcgtggtggaccacattaaagccaat

SEQ ID NO: 2765 - DNA, 42 bp, Artificial Sequence
  Description of Artificial Sequence: Synthetic oligonucleotide
ccgcgtgaagttatcgaagcgattaagaacctggcgaagacc

SEQ ID NO: 2766 - DNA, 42 bp, Artificial Sequence
  Description of Artificial Sequence: Synthetic oligonucleotide
ctgaaagatgccatcaatgaagcgatgcgcgactgggtgacc

SEQ ID NO: 2767 - DNA, 42 bp, Artificial Sequence
  Description of Artificial Sequence: Synthetic oligonucleotide
tatgcgctgcgcaagcatctggtggagttagcgaaaacgaat

SEQ ID NO: 2768 - DNA, 42 bp, Artificial Sequence
  Description of Artificial Sequence: Synthetic oligonucleotide
tgggaacgtttattagaaaaacgtcaaatcggcgcggacacc

SEQ ID NO: 2769 - DNA, 42 bp, Artificial Sequence
  Description of Artificial Sequence: Synthetic oligonucleotide
cagaatggcttagagcaggcgaaaaagttccatgaagccgtg

SEQ ID NO: 2770 - DNA, 42 bp, Artificial Sequence
  Description of Artificial Sequence: Synthetic oligonucleotide
ctggatgaatctgttggcaaaatttggcaaaagctggtggat

SEQ ID NO: 2771 - DNA, 42 bp, Artificial Sequence
  Description of Artificial Sequence: Synthetic oligonucleotide
ctggaaaaaacgcacgaactgaaagaggttctgaataaggtg

SEQ ID NO: 2772 - DNA, 42 bp, Artificial Sequence
  Description of Artificial Sequence: Synthetic oligonucleotide
aatcgtggcttagagattgcgaaaatcgccgaaaaagttagc

SEQ ID NO: 2773 - DNA, 42 bp, Artificial Sequence
  Description of Artificial Sequence: Synthetic oligonucleotide
gaacagctggagaacgaaattattaaggccggcaaagccagc

SEQ ID NO: 2774 - DNA, 42 bp, Artificial Sequence
  Description of Artificial Sequence: Synthetic oligonucleotide
cgtgaaagccaattaaatgatgcgatcaagattctgaacgaa

SEQ ID NO: 2775 - DNA, 42 bp, Artificial Sequence
  Description of Artificial Sequence: Synthetic oligonucleotide
agcgatcagcgcgacgcgattgtgaagggtctgaaagccaaa

SEQ ID NO: 2776 - DNA, 42 bp, Artificial Sequence
  Description of Artificial Sequence: Synthetic oligonucleotide
gcgacccaggttttaaaagaactggaggaggcgaaaaaggcg

SEQ ID NO: 2777 - DNA, 42 bp, Artificial Sequence
  Description of Artificial Sequence: Synthetic oligonucleotide
gatagcgtgacggcccgtctgcgtgaggttgaacatcgcgcg

SEQ ID NO: 2778 - DNA, 42 bp, Artificial Sequence
  Description of Artificial Sequence: Synthetic oligonucleotide
ccgggcgaacgcgacgcgctgctggccaacgaagcgacgaaa

SEQ ID NO: 2779 - DNA, 42 bp, Artificial Sequence
  Description of Artificial Sequence: Synthetic oligonucleotide
aatagcaaagccaaggaaaatgcggagacgaccctgttacgt

SEQ ID NO: 2780 - DNA, 42 bp, Artificial Sequence
  Description of Artificial Sequence: Synthetic oligonucleotide
attaccgaaacggccaaaaaatgggtgccagagatgcgtgaa

SEQ ID NO: 2781 - DNA, 42 bp, Artificial Sequence
  Description of Artificial Sequence: Synthetic oligonucleotide
tttgaaaatttaatcccgattctgaagacggtgcatgagaaa

SEQ ID NO: 2782 - DNA, 42 bp, Artificial Sequence
  Description of Artificial Sequence: Synthetic oligonucleotide
aataaagaagccaaggcgtgggcgaaaggtgttctggaaaat

SEQ ID NO: 2783 - DNA, 42 bp, Artificial Sequence
  Description of Artificial Sequence: Synthetic oligonucleotide
gatgtgagcaagacgattaaagaagccatcgaaaccacgatt

SEQ ID NO: 2784 - DNA, 42 bp, Artificial Sequence
  Description of Artificial Sequence: Synthetic oligonucleotide
agcatggaattattaaaacaggcgtacgacaaagtgcgcgaa

SEQ ID NO: 2785 - DNA, 42 bp, Artificial Sequence
  Description of Artificial Sequence: Synthetic oligonucleotide
aaacaggaattcgacacccatatggcgaacggtaaagatacc

SEQ ID NO: 2786 - DNA, 42 bp, Artificial Sequence
  Description of Artificial Sequence: Synthetic oligonucleotide
cgtagcaaaggtaaggaagtgatggaatctttcattaaagcg

SEQ ID NO: 2787 - DNA, 42 bp, Artificial Sequence
  Description of Artificial Sequence: Synthetic oligonucleotide
caggaaaaagccaagaccctgctggacaaggcgctgacgcag

SEQ ID NO: 2788 - DNA, 42 bp, Artificial Sequence
  Description of Artificial Sequence: Synthetic oligonucleotide
acccatctggccgacgtgctggtgtctaagcagtttcacgaa

SEQ ID NO: 2789 - DNA, 42 bp, Artificial Sequence
  Description of Artificial Sequence: Synthetic oligonucleotide
gtggataaaatccgcgaatttctgcaaaagattagcaaggaa

SEQ ID NO: 2790 - DNA, 42 bp, Artificial Sequence
  Description of Artificial Sequence: Synthetic oligonucleotide
cgtgcgcgtatccacgcgctgctggaccaagtggcggagagc

SEQ ID NO: 2791 - DNA, 42 bp, Artificial Sequence
  Description of Artificial Sequence: Synthetic oligonucleotide
ccggatgtgacgcgcgatattctggttaacctggataaggtg

SEQ ID NO: 2792 - DNA, 42 bp, Artificial Sequence
  Description of Artificial Sequence: Synthetic oligonucleotide
attgataccgttttatatatgaaagaaaaggccaccaaagcg

SEQ ID NO: 2793 - DNA, 42 bp, Artificial Sequence
  Description of Artificial Sequence: Synthetic oligonucleotide
gaactgtttcgcaaggaagcgaccaagttaattggccaaatt

SEQ ID NO: 2794 - DNA, 42 bp, Artificial Sequence
  Description of Artificial Sequence: Synthetic oligonucleotide
tttattaaaatcaacgatctggcggagcaaattgaaaagatt

SEQ ID NO: 2795 - DNA, 42 bp, Artificial Sequence
  Description of Artificial Sequence: Synthetic oligonucleotide
aaagatcgtatcggttttagcatgatttctgacgcggaaaaa

SEQ ID NO: 2796 - DNA, 42 bp, Artificial Sequence
  Description of Artificial Sequence: Synthetic oligonucleotide
ctggaaaaagccaaggaaaccattttatctattctgaagaaa

SEQ ID NO: 2797 - DNA, 42 bp, Artificial Sequence
  Description of Artificial Sequence: Synthetic oligonucleotide
gaaaaagtgcgcgagagcctgcgtttaacgtttcatgacgcg

SEQ ID NO: 2798 - DNA, 42 bp, Artificial Sequence
  Description of Artificial Sequence: Synthetic oligonucleotide
cagcagcgtgacttccagcgtgaaatccaaattctgaaggcg

SEQ ID NO: 2799 - DNA, 42 bp, Artificial Sequence
  Description of Artificial Sequence: Synthetic oligonucleotide
ccgcatgaattaacgcgtgtggcgtctgccctgcgtaagctg

SEQ ID NO: 2800 - DNA, 42 bp, Artificial Sequence
  Description of Artificial Sequence: Synthetic oligonucleotide
accgaacatttagacgcggtgtttcaacgcatgaaaaccgaa

SEQ ID NO: 2801 - DNA, 42 bp, Artificial Sequence
  Description of Artificial Sequence: Synthetic oligonucleotide
gaaaaaattcaaaaggaagcgcaggaggccctggaaaagctg

SEQ ID NO: 2802 - DNA, 42 bp, Artificial Sequence
  Description of Artificial Sequence: Synthetic oligonucleotide
ccggaaaatacgcgcctgtttgaaatggttaagcgtaaagaa

SEQ ID NO: 2803 - DNA, 42 bp, Artificial Sequence
  Description of Artificial Sequence: Synthetic oligonucleotide
cagacccatgccaagcgtgcgtatcgcgagctggtgttaatg

SEQ ID NO: 2804 - DNA, 42 bp, Artificial Sequence
  Description of Artificial Sequence: Synthetic oligonucleotide
atggcgaatatgcgcgccgtgcgtgaattaacggaagcgcat

SEQ ID NO: 2805 - DNA, 42 bp, Artificial Sequence
  Description of Artificial Sequence: Synthetic oligonucleotide
gataccaaattagccgaatataccgacttaatgctgaaactg

SEQ ID NO: 2806 - DNA, 42 bp, Artificial Sequence
  Description of Artificial Sequence: Synthetic oligonucleotide
cagcatgaacgctacgtggaacagttaaagcaggcgttaaaa

SEQ ID NO: 2807 - DNA, 42 bp, Artificial Sequence
  Description of Artificial Sequence: Synthetic oligonucleotide
agcgaaaaaggtatcgcggatattcgcgccctgctgcaaaaa

SEQ ID NO: 2808 - DNA, 42 bp, Artificial Sequence
  Description of Artificial Sequence: Synthetic oligonucleotide
catgaagtgtctttactgagcgcggagggtgtgctgcgccat

SEQ ID NO: 2809 - DNA, 42 bp, Artificial Sequence
  Description of Artificial Sequence: Synthetic oligonucleotide
ctggaagaagccaaggaaaatctgtacaaggcggcgtctctg

SEQ ID NO: 2810 - DNA, 42 bp, Artificial Sequence
  Description of Artificial Sequence: Synthetic oligonucleotide
gaaagcaaagttgaggcgctggatgagttagtgaccaagaaa

SEQ ID NO: 2811 - DNA, 42 bp, Artificial Sequence
  Description of Artificial Sequence: Synthetic oligonucleotide
gtgcgtcatcaacgcgcggtggaaaaccgcctgcgtgaggcg

SEQ ID NO: 2812 - DNA, 42 bp, Artificial Sequence
  Description of Artificial Sequence: Synthetic oligonucleotide
gcggaagaattatctaaagcggtggttgagaccgtgcgcgcg

SEQ ID NO: 2813 - DNA, 42 bp, Artificial Sequence
  Description of Artificial Sequence: Synthetic oligonucleotide
ccgattcgtgacaaggaagcgattcgcgttctgagcgacacc

SEQ ID NO: 2814 - DNA, 42 bp, Artificial Sequence
  Description of Artificial Sequence: Synthetic oligonucleotide
aaagaaagcatcgaccgtattattcaagttgcgaaagagacc

SEQ ID NO: 2815 - DNA, 42 bp, Artificial Sequence
  Description of Artificial Sequence: Synthetic oligonucleotide
gaaaaagtgaagggtattgaagaattaatcaccaattacagc

SEQ ID NO: 2816 - DNA, 42 bp, Artificial Sequence
  Description of Artificial Sequence: Synthetic oligonucleotide
gcggaacagaagaaggaactgagcgacatcgcgctgcgcatt

SEQ ID NO: 2817 - DNA, 42 bp, Artificial Sequence
  Description of Artificial Sequence: Synthetic oligonucleotide
accgaacatcacgagcgtgcggaacgcgtttttaatttactg

SEQ ID NO: 2818 - DNA, 42 bp, Artificial Sequence
  Description of Artificial Sequence: Synthetic oligonucleotide
gatgcgaatgttaagcgtgtggcggacttaattaaagagagc

SEQ ID NO: 2819 - DNA, 42 bp, Artificial Sequence
  Description of Artificial Sequence: Synthetic oligonucleotide
gtggaaagcgccgttacccgtgtgaaggccatgatggatgaa

SEQ ID NO: 2820 - DNA, 42 bp, Artificial Sequence
  Description of Artificial Sequence: Synthetic oligonucleotide
ctggaacgtcaagtttatgaactggagaagctgcaggagaaa

SEQ ID NO: 2821 - DNA, 42 bp, Artificial Sequence
  Description of Artificial Sequence: Synthetic oligonucleotide
gaagaaaatcgcaaggcggtgagcgaccaactgaaaaagcat

SEQ ID NO: 2822 - DNA, 42 bp, Artificial Sequence
  Description of Artificial Sequence: Synthetic oligonucleotide
ggcaaaaatgccgagctgattagcgagaagattctgaaggaa

SEQ ID NO: 2823 - DNA, 42 bp, Artificial Sequence
  Description of Artificial Sequence: Synthetic oligonucleotide
gaacagctgttacgcaaagcggaagcccaagcgaaaaaggaa

SEQ ID NO: 2824 - DNA, 42 bp, Artificial Sequence
  Description of Artificial Sequence: Synthetic oligonucleotide
aaagataatgccgacaccctggcggcccgcgcgaaaaacgcg

SEQ ID NO: 2825 - DNA, 42 bp, Artificial Sequence
  Description of Artificial Sequence: Synthetic oligonucleotide
cgtaccgaacgcgacaaactgatgcagacggttgcgcatgtg

SEQ ID NO: 2826 - DNA, 42 bp, Artificial Sequence
  Description of Artificial Sequence: Synthetic oligonucleotide
agccatgatcgcttacgtgtgcatcaaatcgcggaagagcat

SEQ ID NO: 2827 - DNA, 42 bp, Artificial Sequence
  Description of Artificial Sequence: Synthetic oligonucleotide
agcctggtggtttctgaactgagcttaaagctgcgtaaggaa

SEQ ID NO: 2828 - DNA, 42 bp, Artificial Sequence
  Description of Artificial Sequence: Synthetic oligonucleotide
attgatgaaggtgttaaaattgtgttagagattaccaagagc

SEQ ID NO: 2829 - DNA, 42 bp, Artificial Sequence
  Description of Artificial Sequence: Synthetic oligonucleotide
ccgcgtaccgttgaggtgcatcgtgccaacgtgatggcgaaa

SEQ ID NO: 2830 - DNA, 42 bp, Artificial Sequence
  Description of Artificial Sequence: Synthetic oligonucleotide
aaagaagtgttaaaggaaagcgcgaagacgattgtggacagc

SEQ ID NO: 2831 - DNA, 42 bp, Artificial Sequence
  Description of Artificial Sequence: Synthetic oligonucleotide
aatggccagttatggaagaaagtgaaagactctctgattgat

SEQ ID NO: 2832 - DNA, 42 bp, Artificial Sequence
  Description of Artificial Sequence: Synthetic oligonucleotide
gatgtggaacgcgccattgaaaccttaatcaaaaatttccat

SEQ ID NO: 2833 - DNA, 42 bp, Artificial Sequence
  Description of Artificial Sequence: Synthetic oligonucleotide
gaatttcaggactctctgaaaaaagttgagaaagcgtctctg

SEQ ID NO: 2834 - DNA, 42 bp, Artificial Sequence
  Description of Artificial Sequence: Synthetic oligonucleotide
gtggataaaacgttccatgatctggttcgcgtgattcgccag

SEQ ID NO: 2835 - DNA, 42 bp, Artificial Sequence
  Description of Artificial Sequence: Synthetic oligonucleotide
gcgaccgcgcaaatggaggaaaaactgcgcgactttacccgt

SEQ ID NO: 2836 - DNA, 42 bp, Artificial Sequence
  Description of Artificial Sequence: Synthetic oligonucleotide
ccggaacagaagaaggaactgagcgacatcgcgcatcgcatt

SEQ ID NO: 2837 - DNA, 42 bp, Artificial Sequence
  Description of Artificial Sequence: Synthetic oligonucleotide
gaaaccgaaaaggttcaggaatttcaacgcctgctgaaggaa

SEQ ID NO: 2838 - DNA, 42 bp, Artificial Sequence
  Description of Artificial Sequence: Synthetic oligonucleotide
agcaccaccgaccaacgtgaacagggtttcaaaagcgagatg

SEQ ID NO: 2839 - DNA, 42 bp, Artificial Sequence
  Description of Artificial Sequence: Synthetic oligonucleotide
gataatggcgagcaacgtaaaggcggtgccctgaaagccttt

SEQ ID NO: 2840 - DNA, 42 bp, Artificial Sequence
  Description of Artificial Sequence: Synthetic oligonucleotide
catgcggatatctacgataaagtgtctggtgatatgcagaaa

SEQ ID NO: 2841 - DNA, 42 bp, Artificial Sequence
  Description of Artificial Sequence: Synthetic oligonucleotide
caggcgacccgcaaccgtgtggaaaaggccgcgcgtgaggtg

SEQ ID NO: 2842 - DNA, 42 bp, Artificial Sequence
  Description of Artificial Sequence: Synthetic oligonucleotide
gaagcggtgcaaaaggaactgctggccgagtggaaacgtacc

SEQ ID NO: 2843 - DNA, 42 bp, Artificial Sequence
  Description of Artificial Sequence: Synthetic oligonucleotide
tttcgtgcgatggcctctgatcagcgtgagttaatgcgtacc

SEQ ID NO: 2844 - DNA, 42 bp, Artificial Sequence
  Description of Artificial Sequence: Synthetic oligonucleotide
attgatgatggtttacgtaaaaccatcgagtggaccaaagcg

SEQ ID NO: 2845 - DNA, 42 bp, Artificial Sequence
  Description of Artificial Sequence: Synthetic oligonucleotide
ctggcggatttccgccagaccattgacaaggtggatgccatt

SEQ ID NO: 2846 - DNA, 42 bp, Artificial Sequence
  Description of Artificial Sequence: Synthetic oligonucleotide
aaagtgacccgcgccattattgaaaacgaggtggataagatt

SEQ ID NO: 2847 - DNA, 42 bp, Artificial Sequence
  Description of Artificial Sequence: Synthetic oligonucleotide
agcagccgtttaaaggatgtggaagccggtctgaaaatcatt

SEQ ID NO: 2848 - DNA, 42 bp, Artificial Sequence
  Description of Artificial Sequence: Synthetic oligonucleotide
ccggtgctggacgagtttgtgaatcacttaaatcgtttacgt

SEQ ID NO: 2849 - DNA, 42 bp, Artificial Sequence
  Description of Artificial Sequence: Synthetic oligonucleotide
ccgaaagaacgcacggaatggattaaagccatccagatggcg

SEQ ID NO: 2850 - DNA, 42 bp, Artificial Sequence
  Description of Artificial Sequence: Synthetic oligonucleotide
attccgcaggccgagaaactggatcaaatgttaaaagaacag

SEQ ID NO: 2851 - DNA, 42 bp, Artificial Sequence
  Description of Artificial Sequence: Synthetic oligonucleotide
gaaaaagcgacgttagaatggctgaaagccatgaagaccaat

SEQ ID NO: 2852 - DNA, 42 bp, Artificial Sequence
  Description of Artificial Sequence: Synthetic oligonucleotide
aaagatctggttttaagcgtgcataaccgcgcgattcgcaat

SEQ ID NO: 2853 - DNA, 42 bp, Artificial Sequence
  Description of Artificial Sequence: Synthetic oligonucleotide
cgtgatgatatgttagcctggattaaaaccatccaagaaagc

SEQ ID NO: 2854 - DNA, 42 bp, Artificial Sequence
  Description of Artificial Sequence: Synthetic oligonucleotide
cagaaaaaagccgacgcgctgaatgccgagcatattcgcatg

SEQ ID NO: 2855 - DNA, 42 bp, Artificial Sequence
  Description of Artificial Sequence: Synthetic oligonucleotide
gtgggcgatttcacggtgcgtctgcgcgaccatctggacacc

SEQ ID NO: 2856 - DNA, 42 bp, Artificial Sequence
  Description of Artificial Sequence: Synthetic oligonucleotide
gtgaatagcttaaagaaagcgctggaggagctgaaagagaaa

SEQ ID NO: 2857 - DNA, 42 bp, Artificial Sequence
  Description of Artificial Sequence: Synthetic oligonucleotide
acctatagcatcacgaaacgtgtgaaggaggtgctgacggat

SEQ ID NO: 2858 - DNA, 42 bp, Artificial Sequence
  Description of Artificial Sequence: Synthetic oligonucleotide
gaaaccgcgttattagattggctgggcacgatgcgcgaaaaa

SEQ ID NO: 2859 - DNA, 42 bp, Artificial Sequence
  Description of Artificial Sequence: Synthetic oligonucleotide
gataatgaaaagaaccgtaaactgttcgacctgctggacgtg

SEQ ID NO: 2860 - DNA, 42 bp, Artificial Sequence
  Description of Artificial Sequence: Synthetic oligonucleotide
gatccgacccgcgagcgtctgaaagccgccgcgcagtctatt

SEQ ID NO: 2861 - DNA, 42 bp, Artificial Sequence
  Description of Artificial Sequence: Synthetic oligonucleotide
gtggatgaaatcgttgaaaatctgcgcaagcaggtgaaggcg

SEQ ID NO: 2862 - DNA, 42 bp, Artificial Sequence
  Description of Artificial Sequence: Synthetic oligonucleotide
gtgccgctgacggttaaagaaatgaatcgcttaattgatgaa

SEQ ID NO: 2863 - DNA, 42 bp, Artificial Sequence
  Description of Artificial Sequence: Synthetic oligonucleotide
gcggaacaggttgttcagggcatgaaagaggcccaggaacgt

SEQ ID NO: 2864 - DNA, 42 bp, Artificial Sequence
  Description of Artificial Sequence: Synthetic oligonucleotide
cgtgaactggcccgccagaccctggaggttgtgcaggagatg

SEQ ID NO: 2865 - DNA, 42 bp, Artificial Sequence
  Description of Artificial Sequence: Synthetic oligonucleotide
gcgaaagatgttgacagccgtgcgcgcgaggtgatttctaaa

SEQ ID NO: 2866 - DNA, 42 bp, Artificial Sequence
  Description of Artificial Sequence: Synthetic oligonucleotide
agcaccgtgcgcgagcagctgaaaaagaagctggtggaggtg

SEQ ID NO: 2867 - DNA, 42 bp, Artificial Sequence
  Description of Artificial Sequence: Synthetic oligonucleotide
gaaaaacaggccaaggaagtgctgaagcaacattttgagaaa

SEQ ID NO: 2868 - DNA, 42 bp, Artificial Sequence
  Description of Artificial Sequence: Synthetic oligonucleotide
accgtgctggttcaccgtgtgcattcttacctggaacgccat

SEQ ID NO: 2869 - DNA, 42 bp, Artificial Sequence
  Description of Artificial Sequence: Synthetic oligonucleotide
ccgcatcatttagcccaggcggaacgcaacgtgcgtgccttt

SEQ ID NO: 2870 - DNA, 42 bp, Artificial Sequence
  Description of Artificial Sequence: Synthetic oligonucleotide
gtggaacgtggtatcaccagcctgcaccacgcgctggagctg

SEQ ID NO: 2871 - DNA, 42 bp, Artificial Sequence
  Description of Artificial Sequence: Synthetic oligonucleotide
gatgaagaacgcaagaccatgatgaatctgatggttgccgcg

SEQ ID NO: 2872 - DNA, 42 bp, Artificial Sequence
  Description of Artificial Sequence: Synthetic oligonucleotide
gaaggcacctaccgccagctgattcgcttacatcagacggaa

SEQ ID NO: 2873 - DNA, 42 bp, Artificial Sequence
  Description of Artificial Sequence: Synthetic oligonucleotide
cagaatctgttagacgaactggataaccgcattattaagaat

SEQ ID NO: 2874 - DNA, 42 bp, Artificial Sequence
  Description of Artificial Sequence: Synthetic oligonucleotide
gaaaaaaccttaatcaataaaattgccgagctgaaaaagttt

SEQ ID NO: 2875 - DNA, 42 bp, Artificial Sequence
  Description of Artificial Sequence: Synthetic oligonucleotide
ctggatgaaatcaacaaaaaagaattatctattaaagaggcg

SEQ ID NO: 2876 - DNA, 42 bp, Artificial Sequence
  Description of Artificial Sequence: Synthetic oligonucleotide
aaagcgagcttaaactggcatcagcgtaagcacgcggaaacc

SEQ ID NO: 2877 - DNA, 42 bp, Artificial Sequence
  Description of Artificial Sequence: Synthetic oligonucleotide
aaagataccatggccaagattagcaatgagttacatgcgatt

SEQ ID NO: 2878 - DNA, 42 bp, Artificial Sequence
  Description of Artificial Sequence: Synthetic oligonucleotide
cgtgataccttagagcgtaccgcggacgagattcgtgccgcg

SEQ ID NO: 2879 - DNA, 42 bp, Artificial Sequence
  Description of Artificial Sequence: Synthetic oligonucleotide
ccgaaactgacgatggagtatgtggaacaagccattaaaaaa

SEQ ID NO: 2880 - DNA, 42 bp, Artificial Sequence
  Description of Artificial Sequence: Synthetic oligonucleotide
ccggaactgatccaaccgattcaggacaagattaaaaacgaa

SEQ ID NO: 2881 - DNA, 42 bp, Artificial Sequence
  Description of Artificial Sequence: Synthetic oligonucleotide
agcaaaaatgagttaagccgtgcgttcaagagcctgttagaa

SEQ ID NO: 2882 - DNA, 42 bp, Artificial Sequence
  Description of Artificial Sequence: Synthetic oligonucleotide
ggcgaagcgcacacgcgtatgcgtcgtttattcaatgcggtg

SEQ ID NO: 2883 - DNA, 42 bp, Artificial Sequence
  Description of Artificial Sequence: Synthetic oligonucleotide
catcgtgaacacatgcaacgtctgcatgactctgcgaaaatt

SEQ ID NO: 2884 - DNA, 42 bp, Artificial Sequence
  Description of Artificial Sequence: Synthetic oligonucleotide
ccggatattgagaagcaggtgatgcgtcaattcgcggatacc

SEQ ID NO: 2885 - DNA, 42 bp, Artificial Sequence
  Description of Artificial Sequence: Synthetic oligonucleotide
aaaagcaccgttacgggcctggtgaagcgcctggaagccgat

SEQ ID NO: 2886 - DNA, 42 bp, Artificial Sequence
  Description of Artificial Sequence: Synthetic oligonucleotide
cgtgaaaaagcccaagaactggtgaacgccgcgcatgagttt

SEQ ID NO: 2887 - DNA, 42 bp, Artificial Sequence
  Description of Artificial Sequence: Synthetic oligonucleotide
gtggatcagaaggttaaaagcacccaagacgtgctgaagagc

SEQ ID NO: 2888 - DNA, 42 bp, Artificial Sequence
  Description of Artificial Sequence: Synthetic oligonucleotide
gatctgctgcaacacaccgcgaatgttgttaaagcgcacaaa

SEQ ID NO: 2889 - DNA, 42 bp, Artificial Sequence
  Description of Artificial Sequence: Synthetic oligonucleotide
gcgaaagatgaccgcgtgtttcagttagccgtgagcgacctg

SEQ ID NO: 2890 - DNA, 42 bp, Artificial Sequence
  Description of Artificial Sequence: Synthetic oligonucleotide
agcgcggatcgcgagaaactggaacgcttcagccattctgaa

SEQ ID NO: 2891 - DNA, 42 bp, Artificial Sequence
  Description of Artificial Sequence: Synthetic oligonucleotide
gcggaaaccgttggtcgtgtgaaacgcttcattcaggaggcg

SEQ ID NO: 2892 - DNA, 42 bp, Artificial Sequence
  Description of Artificial Sequence: Synthetic oligonucleotide
cgtcagaaagccgagcaggtggcggacgagatttatcaagcg

SEQ ID NO: 2893 - DNA, 42 bp, Artificial Sequence
  Description of Artificial Sequence: Synthetic oligonucleotide
gtgctgagcaagttactgcgtgattctcacgtgctgcacagc

SEQ ID NO: 2894 - DNA, 42 bp, Artificial Sequence
  Description of Artificial Sequence: Synthetic oligonucleotide
attgaaaataaggccgcggattatttaaaggtgagcgccaaa

SEQ ID NO: 2895 - DNA, 42 bp, Artificial Sequence
  Description of Artificial Sequence: Synthetic oligonucleotide
aaagaactgcgcgactggattgcgcagacgttaaatgatctg

SEQ ID NO: 2896 - DNA, 42 bp, Artificial Sequence
  Description of Artificial Sequence: Synthetic oligonucleotide
gaacgtcagatcaagaaacagaccgccttagtggaattagtg

SEQ ID NO: 2897 - DNA, 42 bp, Artificial Sequence
  Description of Artificial Sequence: Synthetic oligonucleotide
ggcgaactgggtcaagcggtgagcgagggtcgtaaaaaggaa

SEQ ID NO: 2898 - DNA, 42 bp, Artificial Sequence
  Description of Artificial Sequence: Synthetic oligonucleotide
gaaaaaaccggtgttgataaaattgttgagcatgtgaagagc

SEQ ID NO: 2899 - DNA, 42 bp, Artificial Sequence
  Description of Artificial Sequence: Synthetic oligonucleotide
gcgcatgatcgcaacctggcgagcttagttgaaaaatacctg

SEQ ID NO: 2900 - DNA, 42 bp, Artificial Sequence
  Description of Artificial Sequence: Synthetic oligonucleotide
tataatctggccttagataaagcgatccaaaaactgcacgat

SEQ ID NO: 2901 - DNA, 42 bp, Artificial Sequence
  Description of Artificial Sequence: Synthetic oligonucleotide
gaaaataccatcaagaccacccgtcgcgttctggaattagtg

SEQ ID NO: 2902 - DNA, 42 bp, Artificial Sequence
  Description of Artificial Sequence: Synthetic oligonucleotide
ctggatgtgcgcatgcaactgaaagaattagcccagaaagaa

SEQ ID NO: 2903 - DNA, 42 bp, Artificial Sequence
  Description of Artificial Sequence: Synthetic oligonucleotide
gatgatcagttaaagagccatgtgcgcggtgcgctgaacgcg

SEQ ID NO: 2904 - DNA, 42 bp, Artificial Sequence
  Description of Artificial Sequence: Synthetic oligonucleotide
gaaggccagttaaagctggcgctgaagacgctggaaaaggcg

SEQ ID NO: 2905 - DNA, 42 bp, Artificial Sequence
  Description of Artificial Sequence: Synthetic oligonucleotide
gaaaccggcaaggagaaactgctgatctctaaaattttcacc

SEQ ID NO: 2906 - DNA, 42 bp, Artificial Sequence
  Description of Artificial Sequence: Synthetic oligonucleotide
cgtctgtatcgcgagctgcaggcggttgccgaaagcttaaaa

SEQ ID NO: 2907 - DNA, 42 bp, Artificial Sequence
  Description of Artificial Sequence: Synthetic oligonucleotide
aatgtgctgacggcccgtgtgctggacaagctggataagtat

SEQ ID NO: 2908 - DNA, 42 bp, Artificial Sequence
  Description of Artificial Sequence: Synthetic oligonucleotide
ctgaatgatgccatgaacaaagcgaccaagttcctgaaagat

SEQ ID NO: 2909 - DNA, 42 bp, Artificial Sequence
  Description of Artificial Sequence: Synthetic oligonucleotide
ctggcggcggcccgccagcatgcgcgcgacgtgctggaccag

SEQ ID NO: 2910 - DNA, 42 bp, Artificial Sequence
  Description of Artificial Sequence: Synthetic oligonucleotide
caggaaattcaagttctgcgtgtggttaagaattttgagcat

SEQ ID NO: 2911 - DNA, 42 bp, Artificial Sequence
  Description of Artificial Sequence: Synthetic oligonucleotide
acctgggatttagttgcggatattgagcgcctgcgtacgcat

SEQ ID NO: 2912 - DNA, 42 bp, Artificial Sequence
  Description of Artificial Sequence: Synthetic oligonucleotide
cgtgaagaagccatcagcaatatggtggttgccctgaaagaa

SEQ ID NO: 2913 - DNA, 42 bp, Artificial Sequence
  Description of Artificial Sequence: Synthetic oligonucleotide
gaaacctataagtctaatctgaaaatcgccgaactgaagctg

SEQ ID NO: 2914 - DNA, 45 bp, Artificial Sequence
  Description of Artificial Sequence: Synthetic oligonucleotide
gaagcggatttatctaaagaactggccatccaggtgcgcaaagtg

SEQ ID NO: 2915 - DNA, 45 bp, Artificial Sequence
  Description of Artificial Sequence: Synthetic oligonucleotide
gtggaagaagttaacgcgctgaaaaacgagattctgaaggcgcat

SEQ ID NO: 2916 - DNA, 45 bp, Artificial Sequence
  Description of Artificial Sequence: Synthetic oligonucleotide
aaaaaaattacgcaatggctggaaaccaagggtgtggaacgcctg

SEQ ID NO: 2917 - DNA, 45 bp, Artificial Sequence
  Description of Artificial Sequence: Synthetic oligonucleotide
gaagatctgcgcacgaaagtggaaaacacgaccaaaaagattttt

SEQ ID NO: 2918 - DNA, 45 bp, Artificial Sequence
  Description of Artificial Sequence: Synthetic oligonucleotide
ccgaccaaattcgccgaaattgtggaggagaatctgaagagcgcg

SEQ ID NO: 2919 - DNA, 45 bp, Artificial Sequence
  Description of Artificial Sequence: Synthetic oligonucleotide
gtgtttgaaacgttaaaagaagtgtctcgcctggtgttagcgcgt

SEQ ID NO: 2920 - DNA, 45 bp, Artificial Sequence
  Description of Artificial Sequence: Synthetic oligonucleotide
cagattcagcgcgagctgaaaaaattagagcagcgtttaaccgcg

SEQ ID NO: 2921 - DNA, 45 bp, Artificial Sequence
  Description of Artificial Sequence: Synthetic oligonucleotide
gcgaaagaaaagacggatctggtgcaaaagtttggcgagagcctg

SEQ ID NO: 2922 - DNA, 45 bp, Artificial Sequence
  Description of Artificial Sequence: Synthetic oligonucleotide
catcgtgaattatgggccaaaattgcgaactctattaatgacatt

SEQ ID NO: 2923 - DNA, 45 bp, Artificial Sequence
  Description of Artificial Sequence: Synthetic oligonucleotide
tggcaggatatctctatgatgcgtatgaaaaccatcggtgaacat

SEQ ID NO: 2924 - DNA, 45 bp, Artificial Sequence
  Description of Artificial Sequence: Synthetic oligonucleotide
acccagaatttagccaaatttgcggttgacgaagaaaacaaaatt

SEQ ID NO: 2925 - DNA, 45 bp, Artificial Sequence
  Description of Artificial Sequence: Synthetic oligonucleotide
agcgaaaaagccgttcgtgaactgttcgcccgtgcgcgcgatagc

SEQ ID NO: 2926 - DNA, 45 bp, Artificial Sequence
  Description of Artificial Sequence: Synthetic oligonucleotide
cgtggcaccaaggccctgatggatgaagttgttaaagcgacgagc

SEQ ID NO: 2927 - DNA, 45 bp, Artificial Sequence
  Description of Artificial Sequence: Synthetic oligonucleotide
ctgcatcaggccatgcgcgcggcgggcgacgagtttgaaacgcgt

SEQ ID NO: 2928 - DNA, 45 bp, Artificial Sequence
  Description of Artificial Sequence: Synthetic oligonucleotide
ctggaagaaacgaagggccagattaacaacagcattaaggatctg

SEQ ID NO: 2929 - DNA, 45 bp, Artificial Sequence
  Description of Artificial Sequence: Synthetic oligonucleotide
agcaccgaagttgccgaacgtgcgcgcgacctggtgcgcgcgacc

SEQ ID NO: 2930 - DNA, 45 bp, Artificial Sequence
  Description of Artificial Sequence: Synthetic oligonucleotide
cgtgatgcgacgttagcgcaggcgaaggagctgtgggcgaaggtg

SEQ ID NO: 2931 - DNA, 45 bp, Artificial Sequence
  Description of Artificial Sequence: Synthetic oligonucleotide
gaacgtctgcacaaccagctgaaagccttaaaacaggacctggcg

SEQ ID NO: 2932 - DNA, 45 bp, Artificial Sequence
  Description of Artificial Sequence: Synthetic oligonucleotide
atggatgatttcatcaaagcgctgcgcacgattaaagagaaaagc

SEQ ID NO: 2933 - DNA, 45 bp, Artificial Sequence
  Description of Artificial Sequence: Synthetic oligonucleotide
agcgatgaagttcaactgattaaaaagacgtgggaaattccagtg

SEQ ID NO: 2934 - DNA, 45 bp, Artificial Sequence
  Description of Artificial Sequence: Synthetic oligonucleotide
ccggaaagcgacaagctgaaaagcgagggtaatgcggccatggcg

SEQ ID NO: 2935 - DNA, 45 bp, Artificial Sequence
  Description of Artificial Sequence: Synthetic oligonucleotide
gtgaaatataagaacgtggcgaaagaggttgcgaatgacattaaa

SEQ ID NO: 2936 - DNA, 45 bp, Artificial Sequence
  Description of Artificial Sequence: Synthetic oligonucleotide
cgtaccgaattattagatattgcggccacgctgtttgccgaacgt

SEQ ID NO: 2937 - DNA, 45 bp, Artificial Sequence
  Description of Artificial Sequence: Synthetic oligonucleotide
cgtcagctggaggccctgattcgtttatctgaagcgcacgcgcgt

SEQ ID NO: 2938 - DNA, 45 bp, Artificial Sequence
  Description of Artificial Sequence: Synthetic oligonucleotide
cgtgaaaccaagacgctgattgtggaggccattgtgcgcgaaacc

SEQ ID NO: 2939 - DNA, 45 bp, Artificial Sequence
  Description of Artificial Sequence: Synthetic oligonucleotide
gcggatgaagttaaggcgatgattaaagaggttgtgagccaattt

SEQ ID NO: 2940 - DNA, 45 bp, Artificial Sequence
  Description of Artificial Sequence: Synthetic oligonucleotide
ctggatgaagttgttgcgatgcagaaaccattcgtgcagaagcat

SEQ ID NO: 2941 - DNA, 45 bp, Artificial Sequence
  Description of Artificial Sequence: Synthetic oligonucleotide
gcgagcaaatctatcagcgatatttctttcgaagtggaccgtctg

SEQ ID NO: 2942 - DNA, 45 bp, Artificial Sequence
  Description of Artificial Sequence: Synthetic oligonucleotide
catagcaccaacgttctgctgagcttaaacgatcagcgcaaaaaa

SEQ ID NO: 2943 - DNA, 45 bp, Artificial Sequence
  Description of Artificial Sequence: Synthetic oligonucleotide
gaagaaaccgcccaaaaagtgattaagttactgaatgccctggaa

SEQ ID NO: 2944 - DNA, 45 bp, Artificial Sequence
  Description of Artificial Sequence: Synthetic oligonucleotide
cgtcaggcgttaggtgaagcgcgtgaggttattaaaaacctggcg

SEQ ID NO: 2945 - DNA, 45 bp, Artificial Sequence
  Description of Artificial Sequence: Synthetic oligonucleotide
gaaagcgaaacgaagagcaccctgttattcggccagcgcgcgaaa

SEQ ID NO: 2946 - DNA, 45 bp, Artificial Sequence
  Description of Artificial Sequence: Synthetic oligonucleotide
gcggaagaacgcaaggaactgcgtacgcaatttcaggacaccacc

SEQ ID NO: 2947 - DNA, 45 bp, Artificial Sequence
  Description of Artificial Sequence: Synthetic oligonucleotide
ccggatgaacgcttaaaactggcgcaagcctataaagagaaaacc

SEQ ID NO: 2948 - DNA, 45 bp, Artificial Sequence
  Description of Artificial Sequence: Synthetic oligonucleotide
ctgagccagttccgcaaaattgtggacaaggtggatcaaaccgcg

SEQ ID NO: 2949 - DNA, 45 bp, Artificial Sequence
  Description of Artificial Sequence: Synthetic oligonucleotide
gatgatctgcacgttggcctggcgcgcttatggcagcgtttaacc

SEQ ID NO: 2950 - DNA, 45 bp, Artificial Sequence
  Description of Artificial Sequence: Synthetic oligonucleotide
gatagcctgatgaagacgcaggcggaattattactggaacgcctg

SEQ ID NO: 2951 - DNA, 45 bp, Artificial Sequence
  Description of Artificial Sequence: Synthetic oligonucleotide
gatcgtcagaacaaggcgtataaagaggccatggaagcgttaaaa

SEQ ID NO: 2952 - DNA, 45 bp, Artificial Sequence
  Description of Artificial Sequence: Synthetic oligonucleotide
attgatgaataccgcgataccctgcgccacctggtggccaccacc

SEQ ID NO: 2953 - DNA, 45 bp, Artificial Sequence
  Description of Artificial Sequence: Synthetic oligonucleotide
ggcgaaaaattatacaccggcctgcgcgaggtggtgacggaacat

SEQ ID NO: 2954 - DNA, 45 bp, Artificial Sequence
  Description of Artificial Sequence: Synthetic oligonucleotide
gtgcaggatgccgttaaacagattatcgactatctggacaccaaa

SEQ ID NO: 2955 - DNA, 45 bp, Artificial Sequence
  Description of Artificial Sequence: Synthetic oligonucleotide
gatggcgcggttaaggcgctggaaacgtggaagaccctgttagat

SEQ ID NO: 2956 - DNA, 45 bp, Artificial Sequence
  Description of Artificial Sequence: Synthetic oligonucleotide
ccggaaaccgagaaggtgctgaaatacttagaagcgacggaacgt

SEQ ID NO: 2957 - DNA, 45 bp, Artificial Sequence
  Description of Artificial Sequence: Synthetic oligonucleotide
catggcgaaatctctctggtgctgaacacgctgcgtgagaaagaa

SEQ ID NO: 2958 - DNA, 45 bp, Artificial Sequence
  Description of Artificial Sequence: Synthetic oligonucleotide
gcgaatgatcacatcgcggtgctggttaagaaattttctctggaa

SEQ ID NO: 2959 - DNA, 45 bp, Artificial Sequence
  Description of Artificial Sequence: Synthetic oligonucleotide
ccgctgagcttagttaaaaaactgaagaaggatggcttacaggat

SEQ ID NO: 2960 - DNA, 45 bp, Artificial Sequence
  Description of Artificial Sequence: Synthetic oligonucleotide
ccgagcgatttacgcgaaaaactgtctgagctggcggacgcgaaa

SEQ ID NO: 2961 - DNA, 45 bp, Artificial Sequence
  Description of Artificial Sequence: Synthetic oligonucleotide
accggcgtggttcgcgatagcatggcgaagttacgtgaacgcctg

SEQ ID NO: 2962 - DNA, 45 bp, Artificial Sequence
  Description of Artificial Sequence: Synthetic oligonucleotide
cagcgtgatgccgagaataccatgcgtgagttagcggtgcgcgaa

SEQ ID NO: 2963 - DNA, 45 bp, Artificial Sequence
  Description of Artificial Sequence: Synthetic oligonucleotide
ccggaacgtgttcgcccggcgctggagaacaccctgaaggatctg

SEQ ID NO: 2964 - DNA, 45 bp, Artificial Sequence
  Description of Artificial Sequence: Synthetic oligonucleotide
agcgaaagcatccaaaaaaaatttcaattaatgaaagaacacgtg

SEQ ID NO: 2965 - DNA, 45 bp, Artificial Sequence
  Description of Artificial Sequence: Synthetic oligonucleotide
gaaaataccgttaactttcatcagaagaacatgcagaaaaagatt

SEQ ID NO: 2966 - DNA, 45 bp, Artificial Sequence
  Description of Artificial Sequence: Synthetic oligonucleotide
gatgaaattaagatcaaactgattaagacgctggcgttcaatgcg

SEQ ID NO: 2967 - DNA, 45 bp, Artificial Sequence
  Description of Artificial Sequence: Synthetic oligonucleotide
tttgataccgccttaaccgatctgaagacgattattcgcgcggaa

SEQ ID NO: 2968 - DNA, 45 bp, Artificial Sequence
  Description of Artificial Sequence: Synthetic oligonucleotide
accgatgatcgcatcaaaagctgggtggcccaactgaaatctgaa

SEQ ID NO: 2969 - DNA, 45 bp, Artificial Sequence
  Description of Artificial Sequence: Synthetic oligonucleotide
cgtctggatcacaaccgtgcgatttctcaactggcggccaaaacc

SEQ ID NO: 2970 - DNA, 45 bp, Artificial Sequence
  Description of Artificial Sequence: Synthetic oligonucleotide
gaaaaactgacgttcaaaaccgatttagagaaactggagcgtgaa

SEQ ID NO: 2971 - DNA, 45 bp, Artificial Sequence
  Description of Artificial Sequence: Synthetic oligonucleotide
catcataccgcctctgaaagctttatgaagcacatgcagaatgaa

SEQ ID NO: 2972 - DNA, 45 bp, Artificial Sequence
  Description of Artificial Sequence: Synthetic oligonucleotide
aaaaaactgttaaaggaagcgtttcaaaagaccctgacggatctg

SEQ ID NO: 2973 - DNA, 45 bp, Artificial Sequence
  Description of Artificial Sequence: Synthetic oligonucleotide
gtggatcagatccgcaaaaattatcactctctggtgtctcagcgt

SEQ ID NO: 2974 - DNA, 45 bp, Artificial Sequence
  Description of Artificial Sequence: Synthetic oligonucleotide
gatcgtgcgaacttcaccctgctgttagccgaactgcacaaagcg

SEQ ID NO: 2975 - DNA, 45 bp, Artificial Sequence
  Description of Artificial Sequence: Synthetic oligonucleotide
gaaagcaataaggagaatcgtgaagcccacctggcggccatgctg

SEQ ID NO: 2976 - DNA, 45 bp, Artificial Sequence
  Description of Artificial Sequence: Synthetic oligonucleotide
catggcagcgacttaggcaaaaaattattagaagcggccaatgtg

SEQ ID NO: 2977 - DNA, 45 bp, Artificial Sequence
  Description of Artificial Sequence: Synthetic oligonucleotide
gcggcggatcgcttaaattatctgaaggacctgagccgcagccat

SEQ ID NO: 2978 - DNA, 45 bp, Artificial Sequence
  Description of Artificial Sequence: Synthetic oligonucleotide
aaatttcaggaggccgtggaaaaagttacgcagcatatccatggc

SEQ ID NO: 2979 - DNA, 45 bp, Artificial Sequence
  Description of Artificial Sequence: Synthetic oligonucleotide
cgtgcggcgtgggccgcccagctggcgcaattacgtgaagacgaa

SEQ ID NO: 2980 - DNA, 45 bp, Artificial Sequence
  Description of Artificial Sequence: Synthetic oligonucleotide
atggatgaagttcaaaatcgtattaaggagattctggacaaacat

SEQ ID NO: 2981 - DNA, 45 bp, Artificial Sequence
  Description of Artificial Sequence: Synthetic oligonucleotide
ccggaacgtgttacgcaggcgattcgcgagtggctgcgtaaggtg

SEQ ID NO: 2982 - DNA, 45 bp, Artificial Sequence
  Description of Artificial Sequence: Synthetic oligonucleotide
aatgaaaaagttggtgaactgcaggccaaggcgctggttgatatt

SEQ ID NO: 2983 - DNA, 45 bp, Artificial Sequence
  Description of Artificial Sequence: Synthetic oligonucleotide
gcgaatggctacttagataaactggcccaagaactgggtcgtaaa

SEQ ID NO: 2984 - DNA, 45 bp, Artificial Sequence
  Description of Artificial Sequence: Synthetic oligonucleotide
cgtcaggcgatcttcgaaaccctggttgccaaaggccgcgaactg

SEQ ID NO: 2985 - DNA, 45 bp, Artificial Sequence
  Description of Artificial Sequence: Synthetic oligonucleotide
ccggatcagcaacgcgattttcagcgcgagattcagatcctgaaa

SEQ ID NO: 2986 - DNA, 45 bp, Artificial Sequence
  Description of Artificial Sequence: Synthetic oligonucleotide
gtgggcgaagtttctaaactggtgaagaaggcgctgtctaatgaa

SEQ ID NO: 2987 - DNA, 45 bp, Artificial Sequence
  Description of Artificial Sequence: Synthetic oligonucleotide
ccgcagatggtgcgcgacacccagcagttattaaaagaaacgcgt

SEQ ID NO: 2988 - DNA, 45 bp, Artificial Sequence
  Description of Artificial Sequence: Synthetic oligonucleotide
ctgaccaaacacttacaggtgtttcgcgaccatctgatcaatcag

SEQ ID NO: 2989 - DNA, 45 bp, Artificial Sequence
  Description of Artificial Sequence: Synthetic oligonucleotide
gaagaaatgaccaagcaagcggaaaaatggatcaaggataatctg

SEQ ID NO: 2990 - DNA, 45 bp, Artificial Sequence
  Description of Artificial Sequence: Synthetic oligonucleotide
cgtgaagaacgcgcccagctgattgccacggcgcgtaaggcggtg

SEQ ID NO: 2991 - DNA, 45 bp, Artificial Sequence
  Description of Artificial Sequence: Synthetic oligonucleotide
accgaaagcgccaaggaagcgtatgttaagctgctggacaccctg

SEQ ID NO: 2992 - DNA, 45 bp, Artificial Sequence
  Description of Artificial Sequence: Synthetic oligonucleotide
gaaaaagatcgcaacgatctgattacgtacctgaaaaaggcgacc

SEQ ID NO: 2993 - DNA, 45 bp, Artificial Sequence
  Description of Artificial Sequence: Synthetic oligonucleotide
aaagcggatttaatcgcgaccgcgcgcaagacctgggatgagcgt

SEQ ID NO: 2994 - DNA, 45 bp, Artificial Sequence
  Description of Artificial Sequence: Synthetic oligonucleotide
catgaaggccgcgccgcgcagaaacgcttagaaaccttactggaa

SEQ ID NO: 2995 - DNA, 45 bp, Artificial Sequence
  Description of Artificial Sequence: Synthetic oligonucleotide
aaagaagcggccacggcggtggcgaaggcctttgaacaagaaacc

SEQ ID NO: 2996 - DNA, 45 bp, Artificial Sequence
  Description of Artificial Sequence: Synthetic oligonucleotide
ctgggccatcaagttgcgagcgattacttacgtattatggagcgt

SEQ ID NO: 2997 - DNA, 45 bp, Artificial Sequence
  Description of Artificial Sequence: Synthetic oligonucleotide
gtggaacagaacttaaaacatgtggttacgattaaacgcgaactg

SEQ ID NO: 2998 - DNA, 45 bp, Artificial Sequence
  Description of Artificial Sequence: Synthetic oligonucleotide
atggaagaacacacgcaggtgattaaggagattattcgcgtggcg

SEQ ID NO: 2999 - DNA, 45 bp, Artificial Sequence
  Description of Artificial Sequence: Synthetic oligonucleotide
gaacgtcaggttcgcattcagctgaaggaccatattgaccgtacc

SEQ ID NO: 3000 - DNA, 45 bp, Artificial Sequence
  Description of Artificial Sequence: Synthetic oligonucleotide
gatgaagtgttcggtgcggtgaaagaccgccagcgtaacctgctg

SEQ ID NO: 3001 - DNA, 45 bp, Artificial Sequence
  Description of Artificial Sequence: Synthetic oligonucleotide
ctgaaagaattagactttaaaattcgccaacagctggttaataat

SEQ ID NO: 3002 - DNA, 45 bp, Artificial Sequence
  Description of Artificial Sequence: Synthetic oligonucleotide
accccgaatgagaagctgctgggccacttagtgaaagagaaatat

SEQ ID NO: 3003 - DNA, 45 bp, Artificial Sequence
  Description of Artificial Sequence: Synthetic oligonucleotide
agcaaagaaaagtggaacgatattgatcaaatcgcgacctctctg

SEQ ID NO: 3004 - DNA, 45 bp, Artificial Sequence
  Description of Artificial Sequence: Synthetic oligonucleotide
tggaaagaagacgttaaaaaaatgattgttttaagcctgacgcgt

SEQ ID NO: 3005 - DNA, 45 bp, Artificial Sequence
  Description of Artificial Sequence: Synthetic oligonucleotide
ggccgtgatttaacggattatctgatgaagatcctgaccgagcgt

SEQ ID NO: 3006 - DNA, 45 bp, Artificial Sequence
  Description of Artificial Sequence: Synthetic oligonucleotide
aaaagcctgatgaaggaggcgtttcagaagacgctgagcgacctg

SEQ ID NO: 3007 - DNA, 45 bp, Artificial Sequence
  Description of Artificial Sequence: Synthetic oligonucleotide
gaagcggaaacgaagagcaccctgatgttcggtcagcgtgccaaa

SEQ ID NO: 3008 - DNA, 45 bp, Artificial Sequence
  Description of Artificial Sequence: Synthetic oligonucleotide
tttaaagatatcaagaaaattatggaagagaagattcagatcagc

SEQ ID NO: 3009 - DNA, 45 bp, Artificial Sequence
  Description of Artificial Sequence: Synthetic oligonucleotide
gatgaagtgcgcaagaccaatctggccggtctgatggatggttat

SEQ ID NO: 3010 - DNA, 45 bp, Artificial Sequence
  Description of Artificial Sequence: Synthetic oligonucleotide
accgcgcgtttagaccgtctgatgctggagcgcgtgctggagcag

SEQ ID NO: 3011 - DNA, 45 bp, Artificial Sequence
  Description of Artificial Sequence: Synthetic oligonucleotide
tatcgtgaagccgttctgcgtgcggttgaccgtctgaacgaacag

SEQ ID NO: 3012 - DNA, 45 bp, Artificial Sequence
  Description of Artificial Sequence: Synthetic oligonucleotide
catggcgcggccacggcgaatgaatctttcaaacgtgcccgtgcg

SEQ ID NO: 3013 - DNA, 45 bp, Artificial Sequence
  Description of Artificial Sequence: Synthetic oligonucleotide
attaaagaacgcacgattaaaattggtaagtatattgttgaaacc

SEQ ID NO: 3014 - DNA, 45 bp, Artificial Sequence
  Description of Artificial Sequence: Synthetic oligonucleotide
gtgagcgatttaaagaaatatattgccgagctggaagttcagacc

SEQ ID NO: 3015 - DNA, 45 bp, Artificial Sequence
  Description of Artificial Sequence: Synthetic oligonucleotide
agcgaagaaaaggttgcgctgtatcgccacgtggtgtctgtggtg

SEQ ID NO: 3016 - DNA, 45 bp, Artificial Sequence
  Description of Artificial Sequence: Synthetic oligonucleotide
ctgccgattatcaaggatcatctgaacgacctgtatcgccaggcg

SEQ ID NO: 3017 - DNA, 45 bp, Artificial Sequence
  Description of Artificial Sequence: Synthetic oligonucleotide
ctggcgacccaagccgtgcaggaaatcaagcatagcttagatcat

SEQ ID NO: 3018 - DNA, 45 bp, Artificial Sequence
  Description of Artificial Sequence: Synthetic oligonucleotide
gaaaaagatacggttctggaagtgttaaagagctttcgccgtgcg

SEQ ID NO: 3019 - DNA, 45 bp, Artificial Sequence
  Description of Artificial Sequence: Synthetic oligonucleotide
gaagtggcgtacttagatcgtgcgtctcaactggtgttacgtgat

SEQ ID NO: 3020 - DNA, 45 bp, Artificial Sequence
  Description of Artificial Sequence: Synthetic oligonucleotide
ggcattaatatccgccagaaagtgaaggagctggtggagtttgcg

SEQ ID NO: 3021 - DNA, 45 bp, Artificial Sequence
  Description of Artificial Sequence: Synthetic oligonucleotide
caggcgctgttagagcgtattcgtgccaaggaagtgcaaaaacag

SEQ ID NO: 3022 - DNA, 45 bp, Artificial Sequence
  Description of Artificial Sequence: Synthetic oligonucleotide
ctgatgaaagacttaattcagaccgccttagaagaaatgcgccag

SEQ ID NO: 3023 - DNA, 45 bp, Artificial Sequence
  Description of Artificial Sequence: Synthetic oligonucleotide
caggatgaagttaaggaactgaatcgcttactgggcaaggtgatt

SEQ ID NO: 3024 - DNA, 45 bp, Artificial Sequence
  Description of Artificial Sequence: Synthetic oligonucleotide
cgtgatattgacgccatgaaaagcgtggccgaggcgagccacaaa

SEQ ID NO: 3025 - DNA, 45 bp, Artificial Sequence
  Description of Artificial Sequence: Synthetic oligonucleotide
gaagcgagcatcgccattagccaggcccgcctggatgagaaaatt

SEQ ID NO: 3026 - DNA, 45 bp, Artificial Sequence
  Description of Artificial Sequence: Synthetic oligonucleotide
ctggcgagccgcacgcgtcatctggcctctgtgctggacaaactg

SEQ ID NO: 3027 - DNA, 45 bp, Artificial Sequence
  Description of Artificial Sequence: Synthetic oligonucleotide
ccgcaggtgacggttgataaactgaagcgcctggaaaacgatttt

SEQ ID NO: 3028 - DNA, 45 bp, Artificial Sequence
  Description of Artificial Sequence: Synthetic oligonucleotide
ggcgcggaagccaacgcgattacccgcgagattctgaaggatatt

SEQ ID NO: 3029 - DNA, 45 bp, Artificial Sequence
  Description of Artificial Sequence: Synthetic oligonucleotide
ccgaccacctctgcccgtgcgctgcgcgactttgtggttgaagat

SEQ ID NO: 3030 - DNA, 45 bp, Artificial Sequence
  Description of Artificial Sequence: Synthetic oligonucleotide
cgtagcgatttacacgcgaccctggttgacgcggcgcgcgcggcg

SEQ ID NO: 3031 - DNA, 45 bp, Artificial Sequence
  Description of Artificial Sequence: Synthetic oligonucleotide
cgtgatgatgccatcgcgtggaaaaccgccttaatggaagcgaat

SEQ ID NO: 3032 - DNA, 45 bp, Artificial Sequence
  Description of Artificial Sequence: Synthetic oligonucleotide
ctgggcgcgttcgagcataatattcaaacgctgaaagaccgtctg

SEQ ID NO: 3033 - DNA, 45 bp, Artificial Sequence
  Description of Artificial Sequence: Synthetic oligonucleotide
gtgcaggcgtctgaccgtctgatgaaagagttacgtgatatctat

SEQ ID NO: 3034 - DNA, 45 bp, Artificial Sequence
  Description of Artificial Sequence: Synthetic oligonucleotide
ctggaagatttagttcgttatgtggagtctaaaatttctcgtacc

SEQ ID NO: 3035 - DNA, 45 bp, Artificial Sequence
  Description of Artificial Sequence: Synthetic oligonucleotide
cgtggcaccaagtctctgatggatgaagttgttaaagcgacgagc

SEQ ID NO: 3036 - DNA, 45 bp, Artificial Sequence
  Description of Artificial Sequence: Synthetic oligonucleotide
tataaagaagccgttctgcgtgcgatcgacggcattaaccagcgt

SEQ ID NO: 3037 - DNA, 45 bp, Artificial Sequence
  Description of Artificial Sequence: Synthetic oligonucleotide
aaagatgatcaagccaaaaaagtgcaagagcatctgaacaaaacc

SEQ ID NO: 3038 - DNA, 45 bp, Artificial Sequence
  Description of Artificial Sequence: Synthetic oligonucleotide
cgtgaaatggtggaccaaattaatcgtgttgcccgtcaggttatt

SEQ ID NO: 3039 - DNA, 45 bp, Artificial Sequence
  Description of Artificial Sequence: Synthetic oligonucleotide
agccatgtggccgagcgtcaggcgcgcgccgcgaaagacgaactg

SEQ ID NO: 3040 - DNA, 45 bp, Artificial Sequence
  Description of Artificial Sequence: Synthetic oligonucleotide
gataaaagcttagacacctttgtgtctaaggtgggcgagattgtg

SEQ ID NO: 3041 - DNA, 45 bp, Artificial Sequence
  Description of Artificial Sequence: Synthetic oligonucleotide
gatcgtaccgccggtgtgctgcgtgacacgctggatcaactgtat

SEQ ID NO: 3042 - DNA, 45 bp, Artificial Sequence
  Description of Artificial Sequence: Synthetic oligonucleotide
aaactggaaacgtacctgaataaagttgaggcggaagccaaagcg

SEQ ID NO: 3043 - DNA, 45 bp, Artificial Sequence
  Description of Artificial Sequence: Synthetic oligonucleotide
accgaagaattaaagaattttctgaaggacctgctggagaaagcg

SEQ ID NO: 3044 - DNA, 45 bp, Artificial Sequence
  Description of Artificial Sequence: Synthetic oligonucleotide
tataaaaaacgcttaaatgaactgatcacggatgcgttaattacc

SEQ ID NO: 3045 - DNA, 45 bp, Artificial Sequence
  Description of Artificial Sequence: Synthetic oligonucleotide
attccggaattacgcgaacgtattaagaacgtggcggagaaaacc

SEQ ID NO: 3046 - DNA, 45 bp, Artificial Sequence
  Description of Artificial Sequence: Synthetic oligonucleotide
ctgaccgaaaaggccattggcgatgttttcagcctgttagaaaaa

SEQ ID NO: 3047 - DNA, 45 bp, Artificial Sequence
  Description of Artificial Sequence: Synthetic oligonucleotide
gatgaagcgatcaaccgtgcggcgatcaacgtgggcaagaaacgt

SEQ ID NO: 3048 - DNA, 45 bp, Artificial Sequence
  Description of Artificial Sequence: Synthetic oligonucleotide
attgcggaaatctctcgtgaactgaagacgctggcgcgcgaactg

SEQ ID NO: 3049 - DNA, 45 bp, Artificial Sequence
  Description of Artificial Sequence: Synthetic oligonucleotide
gaacgtgtgcaaaagcatctgaaagccttaaccagcgagctggcg

SEQ ID NO: 3050 - DNA, 45 bp, Artificial Sequence
  Description of Artificial Sequence: Synthetic oligonucleotide
ccgaaagaaatgaaggagtttctggatgagcaccagaaaatgacc

SEQ ID NO: 3051 - DNA, 45 bp, Artificial Sequence
  Description of Artificial Sequence: Synthetic oligonucleotide
gaagaaggccgcgaggcggtgagccaaatcgcggcgtctattaaa

SEQ ID NO: 3052 - DNA, 45 bp, Artificial Sequence
  Description of Artificial Sequence: Synthetic oligonucleotide
gcggcggatttaaaggcggtgcaggacaagctgaaaacgtttgtg

SEQ ID NO: 3053 - DNA, 45 bp, Artificial Sequence
  Description of Artificial Sequence: Synthetic oligonucleotide
aaagatgaagttaaggaactgatttggaagtctagcctggaggtg

SEQ ID NO: 3054 - DNA, 45 bp, Artificial Sequence
  Description of Artificial Sequence: Synthetic oligonucleotide
attattccgcgcacgctgcatcagatcttcgaaaaattaaccgat

SEQ ID NO: 3055 - DNA, 45 bp, Artificial Sequence
  Description of Artificial Sequence: Synthetic oligonucleotide
attaaagatgttcacgcgcgtctgcaagccctggcgcaagcgcat

SEQ ID NO: 3056 - DNA, 45 bp, Artificial Sequence
  Description of Artificial Sequence: Synthetic oligonucleotide
gcgcatcaggttcaaaaacagaccttaaaggaaattttactgaaa

SEQ ID NO: 3057 - DNA, 45 bp, Artificial Sequence
  Description of Artificial Sequence: Synthetic oligonucleotide
tttaaacagaagatcattagcattttagaggataaaaaggcggtg

SEQ ID NO: 3058 - DNA, 45 bp, Artificial Sequence
  Description of Artificial Sequence: Synthetic oligonucleotide
ctggaaagctctcacgcgctggcgcacgccctgaaaatgatgcgt

SEQ ID NO: 3059 - DNA, 45 bp, Artificial Sequence
  Description of Artificial Sequence: Synthetic oligonucleotide
atggtgagcgttgttcatgatctgcaaaaggcgattgccgaaaaa

SEQ ID NO: 3060 - DNA, 45 bp, Artificial Sequence
  Description of Artificial Sequence: Synthetic oligonucleotide
gcggaagaaacgttaaaagcgctgaagggtagcgtgaaggatctg

SEQ ID NO: 3061 - DNA, 45 bp, Artificial Sequence
  Description of Artificial Sequence: Synthetic oligonucleotide
cattggaatcgcttacgtgatgatgccgccaatctgaagagcaaa

SEQ ID NO: 3062 - DNA, 45 bp, Artificial Sequence
  Description of Artificial Sequence: Synthetic oligonucleotide
tttgtggaaaacgttatgaaaaaagcgatcgacagcctgaaggaa

SEQ ID NO: 3063 - DNA, 45 bp, Artificial Sequence
  Description of Artificial Sequence: Synthetic oligonucleotide
gaagaactggttaagtggggcaaacgtgttgccgcggcgaacagc

SEQ ID NO: 3064 - DNA, 45 bp, Artificial Sequence
  Description of Artificial Sequence: Synthetic oligonucleotide
aaaagccgtttaatcgatcgtgcgtctcaactgctggaggtgatt

SEQ ID NO: 3065 - DNA, 45 bp, Artificial Sequence
  Description of Artificial Sequence: Synthetic oligonucleotide
cgtgaaagcgttcaccgtctggtggagaacgtggcggagcgtttt

SEQ ID NO: 3066 - DNA, 45 bp, Artificial Sequence
  Description of Artificial Sequence: Synthetic oligonucleotide
accccggatggtatcattaaagcggacaaggtgtttaacaaagtg

SEQ ID NO: 3067 - DNA, 45 bp, Artificial Sequence
  Description of Artificial Sequence: Synthetic oligonucleotide
tatgatgatacggttcgtctgaccatgcaacacgcgcagcaacat

SEQ ID NO: 3068 - DNA, 45 bp, Artificial Sequence
  Description of Artificial Sequence: Synthetic oligonucleotide
gcgcgtgtgcgcaaccagtttctgaaggagatggatggcttagcg

SEQ ID NO: 3069 - DNA, 45 bp, Artificial Sequence
  Description of Artificial Sequence: Synthetic oligonucleotide
ctggcggatttccgccagaccattgacaaggtggatgccattgcg

SEQ ID NO: 3070 - DNA, 45 bp, Artificial Sequence
  Description of Artificial Sequence: Synthetic oligonucleotide
gaagtgaaattattagtggaacgtatgatggccttacagaccgat

SEQ ID NO: 3071 - DNA, 45 bp, Artificial Sequence
  Description of Artificial Sequence: Synthetic oligonucleotide
gtgaaagatcgcttagcggatattaagtctgaaattgacctgacc

SEQ ID NO: 3072 - DNA, 45 bp, Artificial Sequence
  Description of Artificial Sequence: Synthetic oligonucleotide
cgtgatcattggaagcgcgtgatgcagggccacgccggcgcgaat

SEQ ID NO: 3073 - DNA, 45 bp, Artificial Sequence
  Description of Artificial Sequence: Synthetic oligonucleotide
ggccgtgcggttaaccatattaaatctgtttggaaagatttactg

SEQ ID NO: 3074 - DNA, 45 bp, Artificial Sequence
  Description of Artificial Sequence: Synthetic oligonucleotide
accctgattgaccaagcgaaagatcgcatccagaaaacgaaaagc

SEQ ID NO: 3075 - DNA, 45 bp, Artificial Sequence
  Description of Artificial Sequence: Synthetic oligonucleotide
gtggaagaatggttaacgcatgcgcgtaaggttacccaggaggcg

SEQ ID NO: 3076 - DNA, 45 bp, Artificial Sequence
  Description of Artificial Sequence: Synthetic oligonucleotide
catcgtgaacacatgcaacgtctgcatgactctgcgaaaatctat

SEQ ID NO: 3077 - DNA, 45 bp, Artificial Sequence
  Description of Artificial Sequence: Synthetic oligonucleotide
ctgcaggcggttttaaaagaagatcaagagaaactgaagctgctg

SEQ ID NO: 3078 - DNA, 45 bp, Artificial Sequence
  Description of Artificial Sequence: Synthetic oligonucleotide
agcccgatggcggaggccctgtttaaatctatcgcggaacgcgaa

SEQ ID NO: 3079 - DNA, 45 bp, Artificial Sequence
  Description of Artificial Sequence: Synthetic oligonucleotide
cgtgaagaagttatcaaaaccctggttgacatggtggcgaagagc

SEQ ID NO: 3080 - DNA, 45 bp, Artificial Sequence
  Description of Artificial Sequence: Synthetic oligonucleotide
cagctggaaaagttaatggaaaatatgcgtaacgacattgcgagc

SEQ ID NO: 3081 - DNA, 45 bp, Artificial Sequence
  Description of Artificial Sequence: Synthetic oligonucleotide
cgtgatcaggttaagcagattctggttgagatggtggcgaagagc

SEQ ID NO: 3082 - DNA, 45 bp, Artificial Sequence
  Description of Artificial Sequence: Synthetic oligonucleotide
ctggataccttaaagaaagatattgccttaggccaggagtttgtg

SEQ ID NO: 3083 - DNA, 45 bp, Artificial Sequence
  Description of Artificial Sequence: Synthetic oligonucleotide
ccggcggaattacgcgcggcgggccgcgccgatctgacgacccgt

SEQ ID NO: 3084 - DNA, 45 bp, Artificial Sequence
  Description of Artificial Sequence: Synthetic oligonucleotide
atgagcgcggtttctctgaaaattgttgagaaagcgaaggaagcg

SEQ ID NO: 3085 - DNA, 45 bp, Artificial Sequence
  Description of Artificial Sequence: Synthetic oligonucleotide
ctgaaaggcgaggttgaaagcattaagaagcagattaaccgtcag

SEQ ID NO: 3086 - DNA, 45 bp, Artificial Sequence
  Description of Artificial Sequence: Synthetic oligonucleotide
ctgaatgcgttccgcgaactgcgtacgcaactggaaaaggcgctg

SEQ ID NO: 3087 - DNA, 45 bp, Artificial Sequence
  Description of Artificial Sequence: Synthetic oligonucleotide
gcgcaggaaatcgacctgaaagtgcgcaagtttctgatcgcgcag

SEQ ID NO: 3088 - DNA, 45 bp, Artificial Sequence
  Description of Artificial Sequence: Synthetic oligonucleotide
cataccgcgttaaaggatattgcgaacaagtatagcgagaaaacc

SEQ ID NO: 3089 - DNA, 45 bp, Artificial Sequence
  Description of Artificial Sequence: Synthetic oligonucleotide
aaagcgctggacaaggtggaaaaagttttagtgagcgcccagcag

SEQ ID NO: 3090 - DNA, 45 bp, Artificial Sequence
  Description of Artificial Sequence: Synthetic oligonucleotide
catgatcatgccgttgtgagcggccgcttagcgggcgagaatatg

SEQ ID NO: 3091 - DNA, 45 bp, Artificial Sequence
  Description of Artificial Sequence: Synthetic oligonucleotide
agcgaagatgccgttaatatggcgcgtgttttagcgctgaaggaa

SEQ ID NO: 3092 - DNA, 45 bp, Artificial Sequence
  Description of Artificial Sequence: Synthetic oligonucleotide
gaagcggatatcgagcgtaccattgccgccgcgcgtacggtgctg

SEQ ID NO: 3093 - DNA, 45 bp, Artificial Sequence
  Description of Artificial Sequence: Synthetic oligonucleotide
cgtaccgaagccgccaatgtggaaaagatcaccaccaagctgctg

SEQ ID NO: 3094 - DNA, 45 bp, Artificial Sequence
  Description of Artificial Sequence: Synthetic oligonucleotide
ggcaaaaatgccgagctgattagcgagaagattctgaaggaaatg

SEQ ID NO: 3095 - DNA, 45 bp, Artificial Sequence
  Description of Artificial Sequence: Synthetic oligonucleotide
aaaaccaccgttatcaatgaagtgtaccaccgtctggttaaagat

SEQ ID NO: 3096 - DNA, 45 bp, Artificial Sequence
  Description of Artificial Sequence: Synthetic oligonucleotide
cgtagccatttacacgatgcgctggttaaccgtgcgcgcgcgctg

SEQ ID NO: 3097 - DNA, 45 bp, Artificial Sequence
  Description of Artificial Sequence: Synthetic oligonucleotide
attatgcagatcttaacccgtgtgaacgaccgtgtggcccgtcat

SEQ ID NO: 3098 - DNA, 45 bp, Artificial Sequence
  Description of Artificial Sequence: Synthetic oligonucleotide
ccgctgggcgacgccaatgaaaccaaggccctgaaacgcgcgttt

SEQ ID NO: 3099 - DNA, 45 bp, Artificial Sequence
  Description of Artificial Sequence: Synthetic oligonucleotide
aattggcagaagcaaatgctggatcgtttaaacgaagcggttaaa

SEQ ID NO: 3100 - DNA, 45 bp, Artificial Sequence
  Description of Artificial Sequence: Synthetic oligonucleotide
gatcgtctgcgccaatttattggcgagttagcgaccttactggat

SEQ ID NO: 3101 - DNA, 45 bp, Artificial Sequence
  Description of Artificial Sequence: Synthetic oligonucleotide
aatggccatgccttactgatgaccgatacgcgcaaacgtttactg

SEQ ID NO: 3102 - DNA, 45 bp, Artificial Sequence
  Description of Artificial Sequence: Synthetic oligonucleotide
atgggcgcgatcttagaaacccagcgcgagctgcgtgaggtgctg

SEQ ID NO: 3103 - DNA, 45 bp, Artificial Sequence
  Description of Artificial Sequence: Synthetic oligonucleotide
catgatgcgttcatcgcgagcgtggacgagagcctgcgcaaactg

SEQ ID NO: 3104 - DNA, 45 bp, Artificial Sequence
  Description of Artificial Sequence: Synthetic oligonucleotide
aaactgaccttcaagaccgatctggagaagctggaacgcgaaaaa

SEQ ID NO: 3105 - DNA, 45 bp, Artificial Sequence
  Description of Artificial Sequence: Synthetic oligonucleotide
ccgcatgtgttacgccatgcgtttgccacgcatctgttaaatcat

SEQ ID NO: 3106 - DNA, 45 bp, Artificial Sequence
  Description of Artificial Sequence: Synthetic oligonucleotide
ctggatcagatcgaccagcgtattgccgccgtgtttcaccatctg

SEQ ID NO: 3107 - DNA, 45 bp, Artificial Sequence
  Description of Artificial Sequence: Synthetic oligonucleotide
cgtgaaaccttagagattagctatcgcaacgcgattgcccgtctg

SEQ ID NO: 3108 - DNA, 45 bp, Artificial Sequence
  Description of Artificial Sequence: Synthetic oligonucleotide
gcggatgcgcgcaagaaactggaagactctgcggaattactgacc

SEQ ID NO: 3109 - DNA, 45 bp, Artificial Sequence
  Description of Artificial Sequence: Synthetic oligonucleotide
agcgaagcggttgttcgtctggcggaggccagccaggaccgttat

SEQ ID NO: 3110 - DNA, 45 bp, Artificial Sequence
  Description of Artificial Sequence: Synthetic oligonucleotide
aaagataaattccaccagctgctgcacgagctggtggagaaaaat

SEQ ID NO: 3111 - DNA, 45 bp, Artificial Sequence
  Description of Artificial Sequence: Synthetic oligonucleotide
ccgcagaaagccatggaggaatataaagagaagctgaaagcccag

SEQ ID NO: 3112 - DNA, 45 bp, Artificial Sequence
  Description of Artificial Sequence: Synthetic oligonucleotide
gatgcggaaacgttaagcaccctgcgcttcggcatgcgtgccaaa

SEQ ID NO: 3113 - DNA, 45 bp, Artificial Sequence
  Description of Artificial Sequence: Synthetic oligonucleotide
atttatgaacaaatcgtgcagaaaatcaaggaacaggttgtgaaa

SEQ ID NO: 3114 - DNA, 45 bp, Artificial Sequence
  Description of Artificial Sequence: Synthetic oligonucleotide
cgtgaaggcgttaaggaactggcgcgccaaaccgcggagctgctg

SEQ ID NO: 3115 - DNA, 45 bp, Artificial Sequence
  Description of Artificial Sequence: Synthetic oligonucleotide
aaagataaattagccgaaattagctacgaggcggtgaagagcgtg

SEQ ID NO: 3116 - DNA, 45 bp, Artificial Sequence
  Description of Artificial Sequence: Synthetic oligonucleotide
caggaagcggacacgctgcgttttgtttctgcgctgcgcgcgcgt

SEQ ID NO: 3117 - DNA, 45 bp, Artificial Sequence
  Description of Artificial Sequence: Synthetic oligonucleotide
ctggaacatttagccgaacgtattgccaaccgtattaacagccag

SEQ ID NO: 3118 - DNA, 45 bp, Artificial Sequence
  Description of Artificial Sequence: Synthetic oligonucleotide
cgtgcgaaattattaaatgtgggcttccaagaagcgttaaaagat

SEQ ID NO: 3119 - DNA, 45 bp, Artificial Sequence
  Description of Artificial Sequence: Synthetic oligonucleotide
attgcgcaggcccgcaaactggtggagcaactgaaaatggaggcg

SEQ ID NO: 3120 - DNA, 45 bp, Artificial Sequence
  Description of Artificial Sequence: Synthetic oligonucleotide
ccgattgtggagaagattctgcagtaccgcgaactgacgaaactg

SEQ ID NO: 3121 - DNA, 45 bp, Artificial Sequence
  Description of Artificial Sequence: Synthetic oligonucleotide
ccgcgtctgcgcgaggcgattgcgcaaaagctgcagcgcgataat

SEQ ID NO: 3122 - DNA, 45 bp, Artificial Sequence
  Description of Artificial Sequence: Synthetic oligonucleotide
acccataaattagccgatgatgtgttacaactgctggacaatcgt

SEQ ID NO: 3123 - DNA, 45 bp, Artificial Sequence
  Description of Artificial Sequence: Synthetic oligonucleotide
gtggaaaaagttttaaaaacccgttaccacgatgcgacgagcaaa

SEQ ID NO: 3124 - DNA, 45 bp, Artificial Sequence
  Description of Artificial Sequence: Synthetic oligonucleotide
gatgatcaggcccgccatctggcggacttaacccgtttaggcatg

SEQ ID NO: 3125 - DNA, 45 bp, Artificial Sequence
  Description of Artificial Sequence: Synthetic oligonucleotide
gtggcggaatctaagaaactgctgaagaagatttttgaccagctg

SEQ ID NO: 3126 - DNA, 45 bp, Artificial Sequence
  Description of Artificial Sequence: Synthetic oligonucleotide
gaaaaagcgttagagctggcggtggcccaaattgaaaagagctat

SEQ ID NO: 3127 - DNA, 45 bp, Artificial Sequence
  Description of Artificial Sequence: Synthetic oligonucleotide
catcatcatcacatgcaacagattcagcgcgacattgcgcaagcg

SEQ ID NO: 3128 - DNA, 45 bp, Artificial Sequence
  Description of Artificial Sequence: Synthetic oligonucleotide
ctgaaaaaaggtatcgatctgtttgagcaaattctgaagcagctg

SEQ ID NO: 3129 - DNA, 45 bp, Artificial Sequence
  Description of Artificial Sequence: Synthetic oligonucleotide
agcaaaggcggtaacctgattgcggacgagctggcggagaaatat

SEQ ID NO: 3130 - DNA, 45 bp, Artificial Sequence
  Description of Artificial Sequence: Synthetic oligonucleotide
ggcgataaagagttagaatggctgattggtcgcagcctgatccag

SEQ ID NO: 3131 - DNA, 45 bp, Artificial Sequence
  Description of Artificial Sequence: Synthetic oligonucleotide
cgtgatcaggttttcgcggcggtggagcaagcgcgtaagaccctg

SEQ ID NO: 3132 - DNA, 45 bp, Artificial Sequence
  Description of Artificial Sequence: Synthetic oligonucleotide
catagcgaaatcatcattaaagcgttcaaccgtgtggttgataaa

SEQ ID NO: 3133 - DNA, 45 bp, Artificial Sequence
  Description of Artificial Sequence: Synthetic oligonucleotide
cgtgatcagttccgcagcaccctggccgacgcggcgaagaccctg

SEQ ID NO: 3134 - DNA, 45 bp, Artificial Sequence
  Description of Artificial Sequence: Synthetic oligonucleotide
aaagaatttatcacgaatcgtattaacgacaccgtgaagaaagcg

SEQ ID NO: 3135 - DNA, 45 bp, Artificial Sequence
  Description of Artificial Sequence: Synthetic oligonucleotide
gcgctggaatctaaggcgaaagtggaccaactggcgcaagattat

SEQ ID NO: 3136 - DNA, 45 bp, Artificial Sequence
  Description of Artificial Sequence: Synthetic oligonucleotide
tgggaacatgccatcgataccgcgcgcgacctgaaaaacattctg

SEQ ID NO: 3137 - DNA, 45 bp, Artificial Sequence
  Description of Artificial Sequence: Synthetic oligonucleotide
accggcgaacacttagaagtgctgtctaagctggcgggtaaattt

SEQ ID NO: 3138 - DNA, 45 bp, Artificial Sequence
  Description of Artificial Sequence: Synthetic oligonucleotide
gaaaaaagcgttatggacggcgcgaaagccgttctggatacgctg

SEQ ID NO: 3139 - DNA, 45 bp, Artificial Sequence
  Description of Artificial Sequence: Synthetic oligonucleotide
gaacatacccgcttacgtggcctggtttctgatgcgttcacccgt

SEQ ID NO: 3140 - DNA, 45 bp, Artificial Sequence
  Description of Artificial Sequence: Synthetic oligonucleotide
accgatgatgttaagagcattgtgcgcttcgtgcaggagcatagc

SEQ ID NO: 3141 - DNA, 45 bp, Artificial Sequence
  Description of Artificial Sequence: Synthetic oligonucleotide
gcggaagatgttaaggtgctgaaatctgttaaaaaacaaattagc

SEQ ID NO: 3142 - DNA, 45 bp, Artificial Sequence
  Description of Artificial Sequence: Synthetic oligonucleotide
gaaaaagatcgcaacgatctgattacgtacctgaaaaaggcgagc

SEQ ID NO: 3143 - DNA, 45 bp, Artificial Sequence
  Description of Artificial Sequence: Synthetic oligonucleotide
attagcgataagttaatggtgcatctggttgagcgtgtgcaacgt

SEQ ID NO: 3144 - DNA, 45 bp, Artificial Sequence
  Description of Artificial Sequence: Synthetic oligonucleotide
cgtgtgggcttcgacgcgctgctgcgcgagcatgtgtctacccat

SEQ ID NO: 3145 - DNA, 45 bp, Artificial Sequence
  Description of Artificial Sequence: Synthetic oligonucleotide
ggcagccatatggccgttagcaaagtgatggagaagattctgcgt

SEQ ID NO: 3146 - DNA, 45 bp, Artificial Sequence
  Description of Artificial Sequence: Synthetic oligonucleotide
gaagcgagccgcaagagcctgtatgacttaaccaaatctctggtg

SEQ ID NO: 3147 - DNA, 45 bp, Artificial Sequence
  Description of Artificial Sequence: Synthetic oligonucleotide
gaagcgcagaagacgctggcggaagaggttaccaaattcattcat

SEQ ID NO: 3148 - DNA, 45 bp, Artificial Sequence
  Description of Artificial Sequence: Synthetic oligonucleotide
atggaagtgttaaagcgtgtgctgaagtctatggatgaaacggcg

SEQ ID NO: 3149 - DNA, 45 bp, Artificial Sequence
  Description of Artificial Sequence: Synthetic oligonucleotide
ccgggcgaattcaagaccctgatttctaaggaacgtaagagccat

SEQ ID NO: 3150 - DNA, 45 bp, Artificial Sequence
  Description of Artificial Sequence: Synthetic oligonucleotide
gcgagcggcgaggcccgtcgtaatggtgccaccgaagcctttaaa

SEQ ID NO: 3151 - DNA, 45 bp, Artificial Sequence
  Description of Artificial Sequence: Synthetic oligonucleotide
aatgcggaagccttaattctggaaatgaacttaattaaaaagcat

SEQ ID NO: 3152 - DNA, 45 bp, Artificial Sequence
  Description of Artificial Sequence: Synthetic oligonucleotide
gaaaaagcgttagagctggcgatggcgcaaatcgataaaaacttt

SEQ ID NO: 3153 - DNA, 45 bp, Artificial Sequence
  Description of Artificial Sequence: Synthetic oligonucleotide
tatggcgatttaaaggcgcgtgtggaccaagtgcgtcaagcgacc

SEQ ID NO: 3154 - DNA, 45 bp, Artificial Sequence
  Description of Artificial Sequence: Synthetic oligonucleotide
ctgaaagaaacgatcgatgataccgcctctcagattttaaaattt

SEQ ID NO: 3155 - DNA, 45 bp, Artificial Sequence
  Description of Artificial Sequence: Synthetic oligonucleotide
gaaattgcgaaggagacccaggcgcgcgttctggaaacgattctg

SEQ ID NO: 3156 - DNA, 45 bp, Artificial Sequence
  Description of Artificial Sequence: Synthetic oligonucleotide
gtgcagctggacacggcggtggtgcgcgccctgcgtgagcgtttt

SEQ ID NO: 3157 - DNA, 45 bp, Artificial Sequence
  Description of Artificial Sequence: Synthetic oligonucleotide
aataaagaaggtttagaactgctgaagacggcgattggtaaagcg

SEQ ID NO: 3158 - DNA, 45 bp, Artificial Sequence
  Description of Artificial Sequence: Synthetic oligonucleotide
ctgagcaccgcccaaaaaattattaaggaggcgcgtgacgcgctg

SEQ ID NO: 3159 - DNA, 45 bp, Artificial Sequence
  Description of Artificial Sequence: Synthetic oligonucleotide
ccgctgagcttagttcgtgatcatcgcgccaaagatgttctgacc

SEQ ID NO: 3160 - DNA, 45 bp, Artificial Sequence
  Description of Artificial Sequence: Synthetic oligonucleotide
cgtaaaagcatcaagcagctggcggaggttgcggaacgcgaaatg

SEQ ID NO: 3161 - DNA, 45 bp, Artificial Sequence
  Description of Artificial Sequence: Synthetic oligonucleotide
cgtagcgatttaaacgcgcgtattttaaagagcgtggttgatcag

SEQ ID NO: 3162 - DNA, 45 bp, Artificial Sequence
  Description of Artificial Sequence: Synthetic oligonucleotide
gaaattgcgaaggagacccaggcgcgcgttctggaagccattctg

SEQ ID NO: 3163 - DNA, 45 bp, Artificial Sequence
  Description of Artificial Sequence: Synthetic oligonucleotide
gaaaaagtggagtctgaaattaaaaaggttgaaaatttcctgcgt

SEQ ID NO: 3164 - DNA, 45 bp, Artificial Sequence
  Description of Artificial Sequence: Synthetic oligonucleotide
caggcgctgcgcgaggcgattgcgcaaaagaccgaacgcctgtat

SEQ ID NO: 3165 - DNA, 45 bp, Artificial Sequence
  Description of Artificial Sequence: Synthetic oligonucleotide
aaactggatgcccaaattaaaaatatctctgatgcgttaggcaaa

SEQ ID NO: 3166 - DNA, 45 bp, Artificial Sequence
  Description of Artificial Sequence: Synthetic oligonucleotide
gaaaaactggacgcccagattaaaaacatcagcgatgccctgggc

SEQ ID NO: 3167 - DNA, 45 bp, Artificial Sequence
  Description of Artificial Sequence: Synthetic oligonucleotide
gatcagcatcgccaagaactggtgaactgggttgataaagttggc

SEQ ID NO: 3168 - DNA, 45 bp, Artificial Sequence
  Description of Artificial Sequence: Synthetic oligonucleotide
cgtgaagaagccatcagcaatatggtggttgccctgaaagagctg

SEQ ID NO: 3169 - DNA, 45 bp, Artificial Sequence
  Description of Artificial Sequence: Synthetic oligonucleotide
aaagaaaccgttgaggcgtggagcgcgcgcatcaaagaacaactg

SEQ ID NO: 3170 - DNA, 45 bp, Artificial Sequence
  Description of Artificial Sequence: Synthetic oligonucleotide
ggccagcaggaggccgcgcgtgcgggtgagctgctgaaggaaaaa

SEQ ID NO: 3171 - DNA, 45 bp, Artificial Sequence
  Description of Artificial Sequence: Synthetic oligonucleotide
aaagaaaccaagggtcatatttttcgcgccgtggaaaacgcgctg

SEQ ID NO: 3172 - DNA, 45 bp, Artificial Sequence
  Description of Artificial Sequence: Synthetic oligonucleotide
agcaaagtgatcatcgatcgtgtgacggagtatctggagagccat

SEQ ID NO: 3173 - DNA, 45 bp, Artificial Sequence
  Description of Artificial Sequence: Synthetic oligonucleotide
agcgtgattggtcgcgaagcgaaagcccaaattctggaggcggaa

SEQ ID NO: 3174 - DNA, 45 bp, Artificial Sequence
  Description of Artificial Sequence: Synthetic oligonucleotide
acctatgaaatgaaccgcattcaggatgccatcaaaaaattaaat

SEQ ID NO: 3175 - DNA, 45 bp, Artificial Sequence
  Description of Artificial Sequence: Synthetic oligonucleotide
tgggtggataaggttaaagatctgacgaagagcgaaatgaacatt

SEQ ID NO: 3176 - DNA, 45 bp, Artificial Sequence
  Description of Artificial Sequence: Synthetic oligonucleotide
cgtgaagaattaacggcggtgatgcgtttcttaacccagcgcctg

SEQ ID NO: 3177 - DNA, 45 bp, Artificial Sequence
  Description of Artificial Sequence: Synthetic oligonucleotide
gtggatgatatcgttaccaaaattaagtcttataccacggaacag

SEQ ID NO: 3178 - DNA, 45 bp, Artificial Sequence
  Description of Artificial Sequence: Synthetic oligonucleotide
ctgccggatgttgaccgtgcggtgttacgcacccaggccaaactg

SEQ ID NO: 3179 - DNA, 45 bp, Artificial Sequence
  Description of Artificial Sequence: Synthetic oligonucleotide
cgtccggaacgcgagaaactgatgcagacggttagcagcatgttt

SEQ ID NO: 3180 - DNA, 45 bp, Artificial Sequence
  Description of Artificial Sequence: Synthetic oligonucleotide
tataaaattgccacgagcattgataaggccattgatcgcattctg

SEQ ID NO: 3181 - DNA, 45 bp, Artificial Sequence
  Description of Artificial Sequence: Synthetic oligonucleotide
gaaaaagatgttcaaaccgcgctggccttagcgaaaggtaaattt

SEQ ID NO: 3182 - DNA, 45 bp, Artificial Sequence
  Description of Artificial Sequence: Synthetic oligonucleotide
cgtgaaaaagccttagaactggcgatggcccaaattgataagaat

SEQ ID NO: 3183 - DNA, 45 bp, Artificial Sequence
  Description of Artificial Sequence: Synthetic oligonucleotide
gtgattatggatttaatccagcgtaccaaggacgcggtgcgcgaa

SEQ ID NO: 3184 - DNA, 45 bp, Artificial Sequence
  Description of Artificial Sequence: Synthetic oligonucleotide
attaaaaaagttcgcgcgagcgtgttatacaatcaggacgaacat

SEQ ID NO: 3185 - DNA, 45 bp, Artificial Sequence
  Description of Artificial Sequence: Synthetic oligonucleotide
aaagatgatgtttacgaaattagcaagttaattctgaagagcatt

SEQ ID NO: 3186 - DNA, 45 bp, Artificial Sequence
  Description of Artificial Sequence: Synthetic oligonucleotide
ccggaagcggccacgcgtgcggtgttcaaggtgctgtctcgtgaa

SEQ ID NO: 3187 - DNA, 45 bp, Artificial Sequence
  Description of Artificial Sequence: Synthetic oligonucleotide
accgtggaaatgttagttaaagtgatttctgagcataaaaaccgt

SEQ ID NO: 3188 - DNA, 45 bp, Artificial Sequence
  Description of Artificial Sequence: Synthetic oligonucleotide
ctggaaagcgccatccagaaagtggttgagaaaatttctcatcgt

SEQ ID NO: 3189 - DNA, 45 bp, Artificial Sequence
  Description of Artificial Sequence: Synthetic oligonucleotide
ccggaaattatcaacgaaatgacccgtatgcgcatggagatgctg

SEQ ID NO: 3190 - DNA, 45 bp, Artificial Sequence
  Description of Artificial Sequence: Synthetic oligonucleotide
cgtggccagttcgacctgctgctgttaaagcatgcggaggaacag

SEQ ID NO: 3191 - DNA, 45 bp, Artificial Sequence
  Description of Artificial Sequence: Synthetic oligonucleotide
ccggaactgaaggccaaaatggaaaccttaaaggaagtgatcacc

SEQ ID NO: 3192 - DNA, 45 bp, Artificial Sequence
  Description of Artificial Sequence: Synthetic oligonucleotide
aatctggattctgcccgttttcgtcacttaatgggcgaaaagctg

SEQ ID NO: 3193 - DNA, 45 bp, Artificial Sequence
  Description of Artificial Sequence: Synthetic oligonucleotide
accgatgtggccaacgaaattgaaaagaagattaaagagaaactg

SEQ ID NO: 3194 - DNA, 45 bp, Artificial Sequence
  Description of Artificial Sequence: Synthetic oligonucleotide
cgtctggatcacaaccgtgcgctgtctcaaattgcggccaaaacc

SEQ ID NO: 3195 - DNA, 45 bp, Artificial Sequence
  Description of Artificial Sequence: Synthetic oligonucleotide
ccggaacatacgatcgcggcggcgaaggttattctgaagaaaagc

SEQ ID NO: 3196 - DNA, 45 bp, Artificial Sequence
  Description of Artificial Sequence: Synthetic oligonucleotide
aaaaatgcgcgcaacgattttctgaaggaggtgaaaatcatgagc

SEQ ID NO: 3197 - DNA, 45 bp, Artificial Sequence
  Description of Artificial Sequence: Synthetic oligonucleotide
gaaaaagcggttgagaaagtggaaaagcaagtgaatgacgcggtg

SEQ ID NO: 3198 - DNA, 45 bp, Artificial Sequence
  Description of Artificial Sequence: Synthetic oligonucleotide
aaagataaaatcatcgataatgcgatcacgctgttttctgaaaaa

SEQ ID NO: 3199 - DNA, 45 bp, Artificial Sequence
  Description of Artificial Sequence: Synthetic oligonucleotide
ctgaaagatgccatcaatgaagcgttacgcgattgggtggccacc

SEQ ID NO: 3200 - DNA, 45 bp, Artificial Sequence
  Description of Artificial Sequence: Synthetic oligonucleotide
acccatgcggaccacgcgcgtagcttccacgcgctgcaccagacc

SEQ ID NO: 3201 - DNA, 45 bp, Artificial Sequence
  Description of Artificial Sequence: Synthetic oligonucleotide
gatgaaatttctgacaccctgcgtacgcgcctggtggccctgacc

SEQ ID NO: 3202 - DNA, 45 bp, Artificial Sequence
  Description of Artificial Sequence: Synthetic oligonucleotide
ctgaaaagcacgttcgatgatattaagaagattatttctaaacag

SEQ ID NO: 3203 - DNA, 45 bp, Artificial Sequence
  Description of Artificial Sequence: Synthetic oligonucleotide
gatgaacagcgcaagctgctgaaagaggcccaggcggagcataat

SEQ ID NO: 3204 - DNA, 45 bp, Artificial Sequence
  Description of Artificial Sequence: Synthetic oligonucleotide
accaatgcgatgcaagacattgcgacccaattcaaaaaagagaaa

SEQ ID NO: 3205 - DNA, 45 bp, Artificial Sequence
  Description of Artificial Sequence: Synthetic oligonucleotide
ggcggcattaaccgcaaacgtgcgttattagaactggagaaaagc

SEQ ID NO: 3206 - DNA, 45 bp, Artificial Sequence
  Description of Artificial Sequence: Synthetic oligonucleotide
gcgaaagaacgcgccagcctgatgaaagcccacggcgaaacgggc

SEQ ID NO: 3207 - DNA, 45 bp, Artificial Sequence
  Description of Artificial Sequence: Synthetic oligonucleotide
atgcgtgaacgcatcgaatttctgaacgaggcgagcgttatgaaa

SEQ ID NO: 3208 - DNA, 45 bp, Artificial Sequence
  Description of Artificial Sequence: Synthetic oligonucleotide
cgtccgcgtatcacggaactggtgggtcaactgctggacgaactg

SEQ ID NO: 3209 - DNA, 45 bp, Artificial Sequence
  Description of Artificial Sequence: Synthetic oligonucleotide
atgaccctggccaagcaggaagcgaagttagtgcatgagaaaatt

SEQ ID NO: 3210 - DNA, 45 bp, Artificial Sequence
  Description of Artificial Sequence: Synthetic oligonucleotide
gtgaaagaagcccaagcggcggcggagcaactgaaaacgacccgt

SEQ ID NO: 3211 - DNA, 45 bp, Artificial Sequence
  Description of Artificial Sequence: Synthetic oligonucleotide
gaaaaaagcgccttagcgtatctggagaagcataccgcccgtctg

SEQ ID NO: 3212 - DNA, 45 bp, Artificial Sequence
  Description of Artificial Sequence: Synthetic oligonucleotide
gaagtgattgacaagattcagaaaaagacgcgtgaattcctgaat

SEQ ID NO: 3213 - DNA, 45 bp, Artificial Sequence
  Description of Artificial Sequence: Synthetic oligonucleotide
agcgaacgttacggtcgtgtgattttagaccgtgtggagcagcgt

SEQ ID NO: 3214 - DNA, 45 bp, Artificial Sequence
  Description of Artificial Sequence: Synthetic oligonucleotide
aaagtggatcgcatcctggcgctggccgagaccaatgccgaactg

SEQ ID NO: 3215 - DNA, 45 bp, Artificial Sequence
  Description of Artificial Sequence: Synthetic oligonucleotide
gcgggcaccaaggagcgtatgcgtgatatcttacgtgaaatccag

SEQ ID NO: 3216 - DNA, 45 bp, Artificial Sequence
  Description of Artificial Sequence: Synthetic oligonucleotide
agcaataaagagaaccgtgaagcgcacttagcggcgatgttagaa

SEQ ID NO: 3217 - DNA, 45 bp, Artificial Sequence
  Description of Artificial Sequence: Synthetic oligonucleotide
aaactgcattctcaagcgaatctgatgcgcttaaaaagcgacctg

SEQ ID NO: 3218 - DNA, 45 bp, Artificial Sequence
  Description of Artificial Sequence: Synthetic oligonucleotide
ggcgcgagccgcgttcgtgatctgttcgagaccgcgaagaaacag

SEQ ID NO: 3219 - DNA, 45 bp, Artificial Sequence
  Description of Artificial Sequence: Synthetic oligonucleotide
gcggaaagcatcgttcgtgaatttgttcaagaagcggttcgtaaa

SEQ ID NO: 3220 - DNA, 45 bp, Artificial Sequence
  Description of Artificial Sequence: Synthetic oligonucleotide
agccagaatcgcggtcgtgaactggttgagaaaatgaaagacctg

SEQ ID NO: 3221 - DNA, 45 bp, Artificial Sequence
  Description of Artificial Sequence: Synthetic oligonucleotide
cgtgcgcagcgcaagctggcgctgacgacgattattgagcatacc

SEQ ID NO: 3222 - DNA, 45 bp, Artificial Sequence
  Description of Artificial Sequence: Synthetic oligonucleotide
ctggaagcgttagagagcaatctgaagaagctgggcgactggctg

SEQ ID NO: 3223 - DNA, 45 bp, Artificial Sequence
  Description of Artificial Sequence: Synthetic oligonucleotide
tttcgtgatttagccctgcgtgtggaccaaattcgtgacaatatg

SEQ ID NO: 3224 - DNA, 45 bp, Artificial Sequence
  Description of Artificial Sequence: Synthetic oligonucleotide
accgatgaaaaggagcgtattctgaagacggtgattgacctggtg

SEQ ID NO: 3225 - DNA, 45 bp, Artificial Sequence
  Description of Artificial Sequence: Synthetic oligonucleotide
ccgaaagaacgcacggaatggattaaagccatccagatggcgagc

SEQ ID NO: 3226 - DNA, 45 bp, Artificial Sequence
  Description of Artificial Sequence: Synthetic oligonucleotide
gaagcgaccttacaagcgatggatgaaaagttacgtaaatggaaa

SEQ ID NO: 3227 - DNA, 45 bp, Artificial Sequence
  Description of Artificial Sequence: Synthetic oligonucleotide
ctggaaaccgttgccgaactgattgcctctaaaaccttagaaaaa

SEQ ID NO: 3228 - DNA, 45 bp, Artificial Sequence
  Description of Artificial Sequence: Synthetic oligonucleotide
attcatgaaggtttaaaactggcgaacgagcagattcaaaaagcg

SEQ ID NO: 3229 - DNA, 45 bp, Artificial Sequence
  Description of Artificial Sequence: Synthetic oligonucleotide
ccggcgcaggccgacctggaatttttagagaatgcgaagaaactg

SEQ ID NO: 3230 - DNA, 45 bp, Artificial Sequence
  Description of Artificial Sequence: Synthetic oligonucleotide
gtggaactgcgcgacgaactggcggcctacattaccaagcagacc

SEQ ID NO: 3231 - DNA, 45 bp, Artificial Sequence
  Description of Artificial Sequence: Synthetic oligonucleotide
accaataatcgcatggagctgaaagcggccatcgaaggcttaaaa

SEQ ID NO: 3232 - DNA, 45 bp, Artificial Sequence
  Description of Artificial Sequence: Synthetic oligonucleotide
gataaagcgatcgacaataccgtgcgccgcgcgaatacgattacc

SEQ ID NO: 3233 - DNA, 45 bp, Artificial Sequence
  Description of Artificial Sequence: Synthetic oligonucleotide
gaaaaagatcgcaacgatctgattacgtacatgaccaaagccgcg

SEQ ID NO: 3234 - DNA, 45 bp, Artificial Sequence
  Description of Artificial Sequence: Synthetic oligonucleotide
gaagcgaccgttaagacccatctggttcacatttattctaaactg

SEQ ID NO: 3235 - DNA, 45 bp, Artificial Sequence
  Description of Artificial Sequence: Synthetic oligonucleotide
agccgtgaaatgcgcttagtggcgagctacttaaaagaagcccag

SEQ ID NO: 3236 - DNA, 45 bp, Artificial Sequence
  Description of Artificial Sequence: Synthetic oligonucleotide
gcgcaggaattagacattaaagcgcgcaactttctgatcaataaa

SEQ ID NO: 3237 - DNA, 45 bp, Artificial Sequence
  Description of Artificial Sequence: Synthetic oligonucleotide
gaacgtaaagacttcattaaaaccacggttaaagaattaattagc

SEQ ID NO: 3238 - DNA, 45 bp, Artificial Sequence
  Description of Artificial Sequence: Synthetic oligonucleotide
gaaggcgatttattcacccagctgcgcaagattgtgaagatggcg

SEQ ID NO: 3239 - DNA, 45 bp, Artificial Sequence
  Description of Artificial Sequence: Synthetic oligonucleotide
aaaccgctgaacaactttgcggcggaggttggcaaaatccgtgat

SEQ ID NO: 3240 - DNA, 45 bp, Artificial Sequence
  Description of Artificial Sequence: Synthetic oligonucleotide
aaagaatttatccgcaaaattgtgcaagccaaacagtctgcggat

SEQ ID NO: 3241 - DNA, 45 bp, Artificial Sequence
  Description of Artificial Sequence: Synthetic oligonucleotide
cgtaaagaattagagacctttattaagaacggcattgacagcacc

SEQ ID NO: 3242 - DNA, 45 bp, Artificial Sequence
  Description of Artificial Sequence: Synthetic oligonucleotide
ctgcgtacccgcatgggtcataccatggcgttagagcgtctggcg

SEQ ID NO: 3243 - DNA, 45 bp, Artificial Sequence
  Description of Artificial Sequence: Synthetic oligonucleotide
accgaaaaagttgtttttcaggaaacgaaggcgattgccgataat

SEQ ID NO: 3244 - DNA, 45 bp, Artificial Sequence
  Description of Artificial Sequence: Synthetic oligonucleotide
attgtgcaggccttagaagaaaccttccgcattggccgcgaactg

SEQ ID NO: 3245 - DNA, 45 bp, Artificial Sequence
  Description of Artificial Sequence: Synthetic oligonucleotide
agcaatgtggttcgcgaactgattgagcgcgtgagcgacaaactg

SEQ ID NO: 3246 - DNA, 45 bp, Artificial Sequence
  Description of Artificial Sequence: Synthetic oligonucleotide
agcagcgatgttgttagctatgtgcgcgaccagctgcgcaaacat

SEQ ID NO: 3247 - DNA, 45 bp, Artificial Sequence
  Description of Artificial Sequence: Synthetic oligonucleotide
ccgctggtgacgaaggtgcatatggaagttgcccgtgcgtctcgt

SEQ ID NO: 3248 - DNA, 45 bp, Artificial Sequence
  Description of Artificial Sequence: Synthetic oligonucleotide
ctgagcgtgatgaaggagacctatgaaacggttatgaaaaaaggc

SEQ ID NO: 3249 - DNA, 45 bp, Artificial Sequence
  Description of Artificial Sequence: Synthetic oligonucleotide
cgtgataaattaaacatgcagctgcagcgcatcattgatgaggcg

SEQ ID NO: 3250 - DNA, 45 bp, Artificial Sequence
  Description of Artificial Sequence: Synthetic oligonucleotide
gtgcaggcgacggaccgtctgatgaaagagttacgtgatatctat

SEQ ID NO: 3251 - DNA, 45 bp, Artificial Sequence
  Description of Artificial Sequence: Synthetic oligonucleotide
cgtgatgaagttgttaatacccgtttctctgcgctgttaaaagaa

SEQ ID NO: 3252 - DNA, 45 bp, Artificial Sequence
  Description of Artificial Sequence: Synthetic oligonucleotide
gaagaaggctctgcctataatgaaaagttaattccgatcagccgt

SEQ ID NO: 3253 - DNA, 45 bp, Artificial Sequence
  Description of Artificial Sequence: Synthetic oligonucleotide
tggaccaaagcctctcagcagattaaccaacatgtgaaggataaa

SEQ ID NO: 3254 - DNA, 45 bp, Artificial Sequence
  Description of Artificial Sequence: Synthetic oligonucleotide
gatgaagtgaagatcaaagtgctgcaacgcctgagcatcgcgagc

SEQ ID NO: 3255 - DNA, 45 bp, Artificial Sequence
  Description of Artificial Sequence: Synthetic oligonucleotide
cgtgcggaagccgaggcggaagtgcaacgcagcgtggagcgtttt

SEQ ID NO: 3256 - DNA, 45 bp, Artificial Sequence
  Description of Artificial Sequence: Synthetic oligonucleotide
gcggaagtgcgccaagcgaccgcggaggccgaacgtgccgtggcg

SEQ ID NO: 3257 - DNA, 45 bp, Artificial Sequence
  Description of Artificial Sequence: Synthetic oligonucleotide
aaagaagtggccaagaaaatggtggaatacatcattgtgaacagc

SEQ ID NO: 3258 - DNA, 45 bp, Artificial Sequence
  Description of Artificial Sequence: Synthetic oligonucleotide
gcggcgcagaagacgctggcggaagaggttaccaaattagtgcat

SEQ ID NO: 3259 - DNA, 45 bp, Artificial Sequence
  Description of Artificial Sequence: Synthetic oligonucleotide
ctggatgaattaaacaaagcgctgcgcttagaagcgttaacccgt

SEQ ID NO: 3260 - DNA, 45 bp, Artificial Sequence
  Description of Artificial Sequence: Synthetic oligonucleotide
gtggaacaggacttaaaacatgtggttacgattaaacgcgaactg

SEQ ID NO: 3261 - DNA, 45 bp, Artificial Sequence
  Description of Artificial Sequence: Synthetic oligonucleotide
gaaaataccgagaagctgctgaaaatcttacgtgataacgtgagc

SEQ ID NO: 3262 - DNA, 45 bp, Artificial Sequence
  Description of Artificial Sequence: Synthetic oligonucleotide
aaactggtgacgaagattattgcgcacgagctggcgcaccagtgg

SEQ ID NO: 3263 - DNA, 45 bp, Artificial Sequence
  Description of Artificial Sequence: Synthetic oligonucleotide
ggcgaagatgcccgcgcggcgctgacgacgctgagcgagcgtgtg

SEQ ID NO: 3264 - DNA, 45 bp, Artificial Sequence
  Description of Artificial Sequence: Synthetic oligonucleotide
gcgacctatgagatcgatcgtgtgttatctcagctgttaaaagaa

SEQ ID NO: 3265 - DNA, 45 bp, Artificial Sequence
  Description of Artificial Sequence: Synthetic oligonucleotide
aatgaatatttaaacctggtgggccgcttacgtaaaatcattgat

SEQ ID NO: 3266 - DNA, 45 bp, Artificial Sequence
  Description of Artificial Sequence: Synthetic oligonucleotide
ccgcgtgaattaaagaccgatctgacggcctttgtggagcaggtg

SEQ ID NO: 3267 - DNA, 45 bp, Artificial Sequence
  Description of Artificial Sequence: Synthetic oligonucleotide
gcggaaagcgttacggcggtgaaagaggccgaaaaagccattcgt

SEQ ID NO: 3268 - DNA, 45 bp, Artificial Sequence
  Description of Artificial Sequence: Synthetic oligonucleotide
agcattcagcgccgcattaaaaaagttacgcatgatatggacatg

SEQ ID NO: 3269 - DNA, 45 bp, Artificial Sequence
  Description of Artificial Sequence: Synthetic oligonucleotide
gcggcgattacgcacaccgcgcgtatggccgacaaactgcgcctg

SEQ ID NO: 3270 - DNA, 45 bp, Artificial Sequence
  Description of Artificial Sequence: Synthetic oligonucleotide
accaaacatttacacaatgatgtggagaaggaacgtaaggaaaaa

SEQ ID NO: 3271 - DNA, 45 bp, Artificial Sequence
  Description of Artificial Sequence: Synthetic oligonucleotide
gcgctgagcaagtctatggcggaaattatccgcgcggatatgcgt

SEQ ID NO: 3272 - DNA, 45 bp, Artificial Sequence
  Description of Artificial Sequence: Synthetic oligonucleotide
gcgctggaattcttactgaaagcgcaccaaaccgcggttgataaa

SEQ ID NO: 3273 - DNA, 45 bp, Artificial Sequence
  Description of Artificial Sequence: Synthetic oligonucleotide
gcggatgcggttttcgcggaagtgcaccgcgcgaatttaagcaaa

SEQ ID NO: 3274 - DNA, 45 bp, Artificial Sequence
  Description of Artificial Sequence: Synthetic oligonucleotide
gaacgtgaattagagcagctgagccgcggttgggtgcgtggtctg

SEQ ID NO: 3275 - DNA, 45 bp, Artificial Sequence
  Description of Artificial Sequence: Synthetic oligonucleotide
accggcgatcgcttaaattttggcttagccgcggaaaaggcgcgt

SEQ ID NO: 3276 - DNA, 45 bp, Artificial Sequence
  Description of Artificial Sequence: Synthetic oligonucleotide
ccggattttttaaagaaaagcgtggacgagagcctgaagcgtctg

SEQ ID NO: 3277 - DNA, 45 bp, Artificial Sequence
  Description of Artificial Sequence: Synthetic oligonucleotide
cattggaatcgcttaaatagcgatgcctctaatctgaagagcaaa

SEQ ID NO: 3278 - DNA, 45 bp, Artificial Sequence
  Description of Artificial Sequence: Synthetic oligonucleotide
gatattcagatggttgagagcattaaacgctacctggaacgcaaa

SEQ ID NO: 3279 - DNA, 45 bp, Artificial Sequence
  Description of Artificial Sequence: Synthetic oligonucleotide
gatgaagcgcgcatcaatcagctgttcttaaccgcgttagataaa

SEQ ID NO: 3280 - DNA, 45 bp, Artificial Sequence
  Description of Artificial Sequence: Synthetic oligonucleotide
gcggcgaccttagaggaaaaactgaacaagatttttgagaaactg

SEQ ID NO: 3281 - DNA, 45 bp, Artificial Sequence
  Description of Artificial Sequence: Synthetic oligonucleotide
gcggcggatgttgaggtgagcctgcgcgccagcctgcaccgtctg

SEQ ID NO: 3282 - DNA, 45 bp, Artificial Sequence
  Description of Artificial Sequence: Synthetic oligonucleotide
cgtaaactgttaaaggaagcgtttcaaaagaccctgacggatctg

SEQ ID NO: 3283 - DNA, 45 bp, Artificial Sequence
  Description of Artificial Sequence: Synthetic oligonucleotide
atggtgcaggccttaaatcgtgcgttagacgaagaaatggccaaa

SEQ ID NO: 3284 - DNA, 45 bp, Artificial Sequence
  Description of Artificial Sequence: Synthetic oligonucleotide
cagtttgaaaagttaatggaaaatatgcgtaacgacattgcgagc

SEQ ID NO: 3285 - DNA, 45 bp, Artificial Sequence
  Description of Artificial Sequence: Synthetic oligonucleotide
gaaagccaggccgagcgtgtgcgtgccgagctggcgcgctttctg

SEQ ID NO: 3286 - DNA, 45 bp, Artificial Sequence
  Description of Artificial Sequence: Synthetic oligonucleotide
ggcctggtgaacaaggcgattcaggacatgatcagcaaacaccat

SEQ ID NO: 3287 - DNA, 45 bp, Artificial Sequence
  Description of Artificial Sequence: Synthetic oligonucleotide
cgtgcgcaggagttaatgattgtgctggaggagtatattcgcacc

SEQ ID NO: 3288 - DNA, 45 bp, Artificial Sequence
  Description of Artificial Sequence: Synthetic oligonucleotide
acccatagcttagcccgttttgcggttgaccagcataacaccaaa

SEQ ID NO: 3289 - DNA, 45 bp, Artificial Sequence
  Description of Artificial Sequence: Synthetic oligonucleotide
cgtaccagcaaggttcgtcagctgttagacaccaccgacattcag

SEQ ID NO: 3290 - DNA, 45 bp, Artificial Sequence
  Description of Artificial Sequence: Synthetic oligonucleotide
gatctgctgaagcacaccaccaatgttgttaaagcgcacaccaat

SEQ ID NO: 3291 - DNA, 45 bp, Artificial Sequence
  Description of Artificial Sequence: Synthetic oligonucleotide
gaagatgaagcccgcgcgattgtggccgcccgtctgaacaccctg

SEQ ID NO: 3292 - DNA, 45 bp, Artificial Sequence
  Description of Artificial Sequence: Synthetic oligonucleotide
gtgtataaatctgccgaagcggtggacttagcgaccaaggaactg

SEQ ID NO: 3293 - DNA, 45 bp, Artificial Sequence
  Description of Artificial Sequence: Synthetic oligonucleotide
ccgctgaaaacgttagaaaccctgcgcaaggaagtgggtgcgtat

SEQ ID NO: 3294 - DNA, 45 bp, Artificial Sequence
  Description of Artificial Sequence: Synthetic oligonucleotide
catgaatatcacgccgaaaccattaagaacgtgcgtacggcgacc

SEQ ID NO: 3295 - DNA, 45 bp, Artificial Sequence
  Description of Artificial Sequence: Synthetic oligonucleotide
ggcatgcgtacgtacctggatctgttacaacatgtgttagatcat

SEQ ID NO: 3296 - DNA, 45 bp, Artificial Sequence
  Description of Artificial Sequence: Synthetic oligonucleotide
gaaaccatgcgtgagcgcaccctgtttgaccgcgcgcgtggtctg

SEQ ID NO: 3297 - DNA, 45 bp, Artificial Sequence
  Description of Artificial Sequence: Synthetic oligonucleotide
gaaaaagcgcaacaagaatatcgtaagacgctggaaaagattatt

SEQ ID NO: 3298 - DNA, 45 bp, Artificial Sequence
  Description of Artificial Sequence: Synthetic oligonucleotide
aatagcattaaggacaaatttgaacaagccctgattgaccgtgtg

SEQ ID NO: 3299 - DNA, 45 bp, Artificial Sequence
  Description of Artificial Sequence: Synthetic oligonucleotide
gaaaaactgaagatcaaagcgcagtcttacctggatgccattcag

SEQ ID NO: 3300 - DNA, 45 bp, Artificial Sequence
  Description of Artificial Sequence: Synthetic oligonucleotide
gtggaacgtttaaagcaggtgctgttacaccagcaggccaaattt

SEQ ID NO: 3301 - DNA, 45 bp, Artificial Sequence
  Description of Artificial Sequence: Synthetic oligonucleotide
cgtgcgcgttacgttaccctggcggcccgcctggaacaagaaacc

SEQ ID NO: 3302 - DNA, 45 bp, Artificial Sequence
  Description of Artificial Sequence: Synthetic oligonucleotide
cagatggaaaagttaaaaggcgcgttagacctgctggagcagttt

SEQ ID NO: 3303 - DNA, 45 bp, Artificial Sequence
  Description of Artificial Sequence: Synthetic oligonucleotide
cgtaatgaagcccgcatgctggtggataaccgcctgcgtcaactg

SEQ ID NO: 3304 - DNA, 45 bp, Artificial Sequence
  Description of Artificial Sequence: Synthetic oligonucleotide
attgaaaataaggccgcggattatttaaaggtgagcgccaaaaat

SEQ ID NO: 3305 - DNA, 45 bp, Artificial Sequence
  Description of Artificial Sequence: Synthetic oligonucleotide
ctgaaagaaatcatcgatgaactgggtaagcaggcgaaggaacag

SEQ ID NO: 3306 - DNA, 45 bp, Artificial Sequence
  Description of Artificial Sequence: Synthetic oligonucleotide
gatgcggatatcttaagctgggcgaatcgcaaggtgcgtacgatg

SEQ ID NO: 3307 - DNA, 45 bp, Artificial Sequence
  Description of Artificial Sequence: Synthetic oligonucleotide
gaacgtaccttagacctggcgatgcagcgcttaaaagcgttcgtg

SEQ ID NO: 3308 - DNA, 45 bp, Artificial Sequence
  Description of Artificial Sequence: Synthetic oligonucleotide
ggcgcggaatctgttctgcaggtgttccgcgaagcgaaggcggaa

SEQ ID NO: 3309 - DNA, 45 bp, Artificial Sequence
  Description of Artificial Sequence: Synthetic oligonucleotide
cgtgaactggccacgcagatttatcacgagaccctgaagattacc

SEQ ID NO: 3310 - DNA, 45 bp, Artificial Sequence
  Description of Artificial Sequence: Synthetic oligonucleotide
tttacccgtttaggtcagctggcggaggacattcagaaggaaatt

SEQ ID NO: 3311 - DNA, 45 bp, Artificial Sequence
  Description of Artificial Sequence: Synthetic oligonucleotide
agcgatgatgttaagaaagcgattatcgagggcaccaaggcgtat

SEQ ID NO: 3312 - DNA, 45 bp, Artificial Sequence
  Description of Artificial Sequence: Synthetic oligonucleotide
gaagcggtggaccaactggtgaaattcaaccgtgcgttagcggat

SEQ ID NO: 3313 - DNA, 45 bp, Artificial Sequence
  Description of Artificial Sequence: Synthetic oligonucleotide
gaatatgtgcgcaagagcgtgggcaacgccctgcgtgacattagc

SEQ ID NO: 3314 - DNA, 45 bp, Artificial Sequence
  Description of Artificial Sequence: Synthetic oligonucleotide
gcggataccttagagcgtgtgaccaagatcattgtggaccgtctg

SEQ ID NO: 3315 - DNA, 45 bp, Artificial Sequence
  Description of Artificial Sequence: Synthetic oligonucleotide
gcgagccagtacatcggcgatctgatccacaaagatatcaaagaa

SEQ ID NO: 3316 - DNA, 45 bp, Artificial Sequence
  Description of Artificial Sequence: Synthetic oligonucleotide
tatcgtcagcgcttaaccgatctgggtgccattgcgaaggcggaa

SEQ ID NO: 3317 - DNA, 45 bp, Artificial Sequence
  Description of Artificial Sequence: Synthetic oligonucleotide
agcgatgatgttaagcgtgcgattgagaagggcaccaacgattat

SEQ ID NO: 3318 - DNA, 45 bp, Artificial Sequence
  Description of Artificial Sequence: Synthetic oligonucleotide
ctgagccagttagagagcgtgatgaaagagttatatcgtgagagc

SEQ ID NO: 3319 - DNA, 45 bp, Artificial Sequence
  Description of Artificial Sequence: Synthetic oligonucleotide
acccatgaaatccaacgtatgattggccgcgccatgcgtaccgcg

SEQ ID NO: 3320 - DNA, 45 bp, Artificial Sequence
  Description of Artificial Sequence: Synthetic oligonucleotide
aataaagatgccttagatctgattcaagaggcgattaagaaagcg

SEQ ID NO: 3321 - DNA, 45 bp, Artificial Sequence
  Description of Artificial Sequence: Synthetic oligonucleotide
atggatagcgttttcgcggaagcgatcgccaaagtgcgcaaacag

SEQ ID NO: 3322 - DNA, 48 bp, Artificial Sequence
  Description of Artificial Sequence: Synthetic oligonucleotide
cagtatggcgagggtctggcgcgtgccgttcaggatggtctgaagaaa

SEQ ID NO: 3323 - DNA, 48 bp, Artificial Sequence
  Description of Artificial Sequence: Synthetic oligonucleotide
agcgcggatcgcgccagcctgattgacgacgcgtttgccctggcccgt

SEQ ID NO: 3324 - DNA, 48 bp, Artificial Sequence
  Description of Artificial Sequence: Synthetic oligonucleotide
ccggatagcaagacgaaactggcgttagacattattaagggcttagaa

SEQ ID NO: 3325 - DNA, 48 bp, Artificial Sequence
  Description of Artificial Sequence: Synthetic oligonucleotide
ccgaaaaccgttgccgaaatgattgatgccttcagccgtgcccgtgat

SEQ ID NO: 3326 - DNA, 48 bp, Artificial Sequence; identical to SEQ ID NO: 1361
  Description of Artificial Sequence: Synthetic oligonucleotide

SEQ ID NO: 3327 - DNA, 48 bp, Artificial Sequence
  Description of Artificial Sequence: Synthetic oligonucleotide
cgtaaagcggttgcccatattaattctgtttggaaagatttactggaa

SEQ ID NO: 3328 - DNA, 48 bp, Artificial Sequence
  Description of Artificial Sequence: Synthetic oligonucleotide
ccggaaacctacggtcgtctgagcgttttactgaaacgcgcggccgaa

SEQ ID NO: 3329 - DNA, 48 bp, Artificial Sequence
  Description of Artificial Sequence: Synthetic oligonucleotide
cgtgaagcgatcgccgcgagcattcacgacgtggtgaaggaagttcag

SEQ ID NO: 3330 - DNA, 48 bp, Artificial Sequence
  Description of Artificial Sequence: Synthetic oligonucleotide
ctggcggatgcccaatatctgcatgagttactgacccgcaaaaacatt

SEQ ID NO: 3331 - DNA, 48 bp, Artificial Sequence
  Description of Artificial Sequence: Synthetic oligonucleotide
aaacaggcgttaatcgatagcgtgtacgcccgtgaaacgaatcgcatt

SEQ ID NO: 3332 - DNA, 48 bp, Artificial Sequence
  Description of Artificial Sequence: Synthetic oligonucleotide
ccgtataccttagacgtgattcgtaaggacctgaaaaagcagttactg

SEQ ID NO: 3333 - DNA, 48 bp, Artificial Sequence
  Description of Artificial Sequence: Synthetic oligonucleotide
gaaaaagaacgcttatttaataatttagcccatctgggtaatatcctg

SEQ ID NO: 3334 - DNA, 48 bp, Artificial Sequence
  Description of Artificial Sequence: Synthetic oligonucleotide
gaaggcgcgcaacaacgtatggcgcaggaggttctgacccacctgaaa

SEQ ID NO: 3335 - DNA, 48 bp, Artificial Sequence
  Description of Artificial Sequence: Synthetic oligonucleotide
aaacaggaattagacgcggcgctgaagaaggcgaaagagctggccagc

SEQ ID NO: 3336 - DNA, 48 bp, Artificial Sequence
  Description of Artificial Sequence: Synthetic oligonucleotide
cgtgaagcgatcgagggctggaaaaaaatcacggatggcgttcatagc

SEQ ID NO: 3337 - DNA, 48 bp, Artificial Sequence
  Description of Artificial Sequence: Synthetic oligonucleotide
agcgtgctggacgaggcggtgcgtgttcgcctgagccgcaatgttgat

SEQ ID NO: 3338 - DNA, 48 bp, Artificial Sequence
  Description of Artificial Sequence: Synthetic oligonucleotide
ccgaaagaaatgaaggagtttctggatgagcaccagaaaatgacgagc

SEQ ID NO: 3339 - DNA, 48 bp, Artificial Sequence
  Description of Artificial Sequence: Synthetic oligonucleotide
gatgaacaggttcgcggctggaataatgttacgaaagcggttcatgcg

SEQ ID NO: 3340 - DNA, 48 bp, Artificial Sequence
  Description of Artificial Sequence: Synthetic oligonucleotide
aaacaggaaatggttgacattattgaaacggtttatcgtggtgcgcgt

SEQ ID NO: 3341 - DNA, 48 bp, Artificial Sequence
  Description of Artificial Sequence: Synthetic oligonucleotide
gcggaacgtttacgcgataaaattttagccagcgaagccagcttcgcg

SEQ ID NO: 3342 - DNA, 48 bp, Artificial Sequence
  Description of Artificial Sequence: Synthetic oligonucleotide
gcgcaggcgaaggccgatgtgctggaccaaattaaattagcgttagat

SEQ ID NO: 3343 - DNA, 48 bp, Artificial Sequence
  Description of Artificial Sequence: Synthetic oligonucleotide
ccggcggatatcgttaaaaatctgaaggacaatatgaccatcctggaa

SEQ ID NO: 3344 - DNA, 48 bp, Artificial Sequence
  Description of Artificial Sequence: Synthetic oligonucleotide
ctgcaggaattagacattaaaattcgcaagattctgtctgataagtat

SEQ ID NO: 3345 - DNA, 48 bp, Artificial Sequence
  Description of Artificial Sequence: Synthetic oligonucleotide
ccgagcctggttaagaaaattaataacatccgtgaagcccgttacgaa

SEQ ID NO: 3346 - DNA, 48 bp, Artificial Sequence
  Description of Artificial Sequence: Synthetic oligonucleotide
ggcgaactggccaagcatgcggtgtctgagggcacccgcgcggttacc

SEQ ID NO: 3347 - DNA, 48 bp, Artificial Sequence
  Description of Artificial Sequence: Synthetic oligonucleotide
gaagatctgaagcaactgaaaagcgccttatataccttactggagacc

SEQ ID NO: 3348 - DNA, 48 bp, Artificial Sequence
  Description of Artificial Sequence: Synthetic oligonucleotide
gaaagcgaaaaggttaatgaaattgttaaggcggtgaagaccgccctg

SEQ ID NO: 3349 - DNA, 48 bp, Artificial Sequence
  Description of Artificial Sequence: Synthetic oligonucleotide
gtggaagaagccgttcgtattgtgaaggaggtgaccgagaaattaagc

SEQ ID NO: 3350 - DNA, 48 bp, Artificial Sequence
  Description of Artificial Sequence: Synthetic oligonucleotide
gcggcggaaaacaagctgaatgattctttaattcaggagctgaagaaa

SEQ ID NO: 3351 - DNA, 48 bp, Artificial Sequence
  Description of Artificial Sequence: Synthetic oligonucleotide
gcgggcaccttagactggattaaagaatcttctgcgctggccaaaaaa

SEQ ID NO: 3352 - DNA, 48 bp, Artificial Sequence
  Description of Artificial Sequence: Synthetic oligonucleotide
tataaagatttagagggcaaagtgaagtctgtgctggagagcaaccgt

SEQ ID NO: 3353 - DNA, 48 bp, Artificial Sequence
  Description of Artificial Sequence: Synthetic oligonucleotide
agcgatgtgaagcaagaactgattaagtacggcaaaaagctggttgaa

SEQ ID NO: 3354 - DNA, 48 bp, Artificial Sequence
  Description of Artificial Sequence: Synthetic oligonucleotide
gaaaatctggttcgcgaacagattgttcgcgtgctgttagaacgcgtg

SEQ ID NO: 3355 - DNA, 48 bp, Artificial Sequence
  Description of Artificial Sequence: Synthetic oligonucleotide
aaaaccagccacgaggaactggcgaagaagctgacccaagtggagaaa

SEQ ID NO: 3356 - DNA, 48 bp, Artificial Sequence
  Description of Artificial Sequence: Synthetic oligonucleotide
cataaagaagttacgaccattgtggaggccattaaagccctggccaat

SEQ ID NO: 3357 - DNA, 48 bp, Artificial Sequence
  Description of Artificial Sequence: Synthetic oligonucleotide
aatcaggcgaaggagctggaacgtttaatcgataaagccatgaaaaaa

SEQ ID NO: 3358 - DNA, 48 bp, Artificial Sequence
  Description of Artificial Sequence: Synthetic oligonucleotide
aaactgaccgagaaggcgattggcgacgtttttagcttactggagaaa

SEQ ID NO: 3359 - DNA, 48 bp, Artificial Sequence
  Description of Artificial Sequence: Synthetic oligonucleotide
aaagaaagcgttgaggcgatgattattgccggtaaaagcgccaatgaa

SEQ ID NO: 3360 - DNA, 48 bp, Artificial Sequence
  Description of Artificial Sequence: Synthetic oligonucleotide
gcgaaagaattaatcgaaaaaagcgttgccctgagcaaggcggttaaa

SEQ ID NO: 3361 - DNA, 48 bp, Artificial Sequence
  Description of Artificial Sequence: Synthetic oligonucleotide
gcgaaaattaagacgattggcattgaggcccgtaaagacatgcaggaa

SEQ ID NO: 3362 - DNA, 48 bp, Artificial Sequence
  Description of Artificial Sequence: Synthetic oligonucleotide
aatgaagtgatcgacaaaatgcgtgcggttcaagaacaggttgcgagc

SEQ ID NO: 3363 - DNA, 48 bp, Artificial Sequence
  Description of Artificial Sequence: Synthetic oligonucleotide
accgaaaaatctaaggaactggcggagatcgtggtgcaagcgttcctg

SEQ ID NO: 3364 - DNA, 48 bp, Artificial Sequence
  Description of Artificial Sequence: Synthetic oligonucleotide
ggcccggtgaaggagaaaattctgtctgttattaaagagtggggcacc

SEQ ID NO: 3365 - DNA, 48 bp, Artificial Sequence
  Description of Artificial Sequence: Synthetic oligonucleotide
gtggcgaaagactctgaagcgattatcaagaatgtgatcgataagtat

SEQ ID NO: 3366 - DNA, 48 bp, Artificial Sequence
  Description of Artificial Sequence: Synthetic oligonucleotide
gaagtgtatcaaatcctggaaaaaggtgccgcgaaacgcaccacggcg

SEQ ID NO: 3367 - DNA, 48 bp, Artificial Sequence
  Description of Artificial Sequence: Synthetic oligonucleotide
caggaacatcgcgttatgctggtgaattctatgaacaccgtgaaggaa

SEQ ID NO: 3368 - DNA, 48 bp, Artificial Sequence
  Description of Artificial Sequence: Synthetic oligonucleotide
ggcgaaagcgagcgcgcggtgcgtcaagtttttcagcgcgcgaagaat

SEQ ID NO: 3369 - DNA, 48 bp, Artificial Sequence
  Description of Artificial Sequence: Synthetic oligonucleotide
cagaataccttagaccataccagcgagcgcattgcgcgcattcgcgtg

SEQ ID NO: 3370 - DNA, 48 bp, Artificial Sequence
  Description of Artificial Sequence: Synthetic oligonucleotide
ccgctgggctctaagattgcgagcgcccgcgaagtgatcaaacgcgat

SEQ ID NO: 3371 - DNA, 48 bp, Artificial Sequence
  Description of Artificial Sequence: Synthetic oligonucleotide
aaagtggaaatccaagtgctggaagacatctataattctctgaacaaa

SEQ ID NO: 3372 - DNA, 48 bp, Artificial Sequence
  Description of Artificial Sequence: Synthetic oligonucleotide
cagaaacgtgagtctattgtgcaggccgccattgcggagtttggtgat

SEQ ID NO: 3373 - DNA, 48 bp, Artificial Sequence
  Description of Artificial Sequence: Synthetic oligonucleotide
ctggatgtggccgccgaaaaaattgaccgctttatgcaggccgtgacc

SEQ ID NO: 3374 - DNA, 48 bp, Artificial Sequence
  Description of Artificial Sequence: Synthetic oligonucleotide
accggcgatcgcttaaattttggcttagccgcggaaaaggcgcgccgt

SEQ ID NO: 3375 - DNA, 48 bp, Artificial Sequence
  Description of Artificial Sequence: Synthetic oligonucleotide
aaaccgaaaaacttagatgcgagcatcacgagcattatccatgagatt

SEQ ID NO: 3376 - DNA, 48 bp, Artificial Sequence
  Description of Artificial Sequence: Synthetic oligonucleotide
gaagattttaaggttgatgcgcagcgcgacattatgcagcgcaccggc

SEQ ID NO: 3377 - DNA, 48 bp, Artificial Sequence
  Description of Artificial Sequence: Synthetic oligonucleotide
gtggatgtggccgagagcctggcgatcgagcgtgcgaagagcttattt

SEQ ID NO: 3378 - DNA, 48 bp, Artificial Sequence
  Description of Artificial Sequence: Synthetic oligonucleotide
catgaaaccgccttacgtgtgaccgccgagcgtgcgatgaacacccgt

SEQ ID NO: 3379 - DNA, 48 bp, Artificial Sequence
  Description of Artificial Sequence: Synthetic oligonucleotide
cagaccaccaaggaggtgctggaagccaaggtgaaaggtctgatccgt

SEQ ID NO: 3380 - DNA, 48 bp, Artificial Sequence
  Description of Artificial Sequence: Synthetic oligonucleotide
ctggatgaaatcttaaaagcgtttaaggaggcgcattctaccgttctg

SEQ ID NO: 3381 - DNA, 48 bp, Artificial Sequence
  Description of Artificial Sequence: Synthetic oligonucleotide
agcagcgcgttagaccaggcggcgcaattacgtacccgcctggagaaa

SEQ ID NO: 3382 - DNA, 48 bp, Artificial Sequence
  Description of Artificial Sequence: Synthetic oligonucleotide
ccgaaaaccgccttaaaaattgtggacacgattcgtaaggatatcctg

SEQ ID NO: 3383 - DNA, 48 bp, Artificial Sequence
  Description of Artificial Sequence: Synthetic oligonucleotide
gtgcgtacctggttaaaggatgcgaaacaagttctgccggaggcgctg

SEQ ID NO: 3384 - DNA, 48 bp, Artificial Sequence
  Description of Artificial Sequence: Synthetic oligonucleotide
attgatgaagttcgcaatgcgctgatccgcggcttttctgaaacgctg

SEQ ID NO: 3385 - DNA, 48 bp, Artificial Sequence
  Description of Artificial Sequence: Synthetic oligonucleotide
ctgagcgaacgcgttcgtgaaagcttaaaggtgtggaaaaacgcggaa

SEQ ID NO: 3386 - DNA, 48 bp, Artificial Sequence
  Description of Artificial Sequence: Synthetic oligonucleotide
cgtgatgatttaaacctggtgctggccacggcggcgaagctgaaggcg

SEQ ID NO: 3387 - DNA, 48 bp, Artificial Sequence
  Description of Artificial Sequence: Synthetic oligonucleotide
aaaaatgtgcgcgacctggcgattaagttacgtgatgccaaacaagat

SEQ ID NO: 3388 - DNA, 48 bp, Artificial Sequence
  Description of Artificial Sequence: Synthetic oligonucleotide
ctgcatgaagttcgcaatgcggtggagaacgcgaatcgcgtgttaagc

SEQ ID NO: 3389 - DNA, 48 bp, Artificial Sequence
  Description of Artificial Sequence: Synthetic oligonucleotide
aaaaccattcaagaggtgattgaagccttaaaaccgttatttgagaaa

SEQ ID NO: 3390 - DNA, 48 bp, Artificial Sequence
  Description of Artificial Sequence: Synthetic oligonucleotide
gaaagccagtacaaggaaatggaagcgaaggttagcagcacgctgagc

SEQ ID NO: 3391 - DNA, 48 bp, Artificial Sequence
  Description of Artificial Sequence: Synthetic oligonucleotide
gcggatcgtttaaaggcgtggaccgaagccttaattcgtgacgtgaat

SEQ ID NO: 3392 - DNA, 48 bp, Artificial Sequence
  Description of Artificial Sequence: Synthetic oligonucleotide
aaagaagaagccttagaactgattaacggttatattcaaaaaatcaaa

SEQ ID NO: 3393 - DNA, 48 bp, Artificial Sequence
  Description of Artificial Sequence: Synthetic oligonucleotide
aaatttgaaaacatgggtgcgcagatggtgcgcgaggtggcgtctcgt

SEQ ID NO: 3394 - DNA, 48 bp, Artificial Sequence
  Description of Artificial Sequence: Synthetic oligonucleotide
agcatgagcgttgaggcggcgaaaaacgcccgtgaattactgttaaaa

SEQ ID NO: 3395 - DNA, 48 bp, Artificial Sequence
  Description of Artificial Sequence: Synthetic oligonucleotide
cgtgcggaagccgaggcggaagtgcaacgcagcgtggagcgtttcaaa

SEQ ID NO: 3396 - DNA, 48 bp, Artificial Sequence
  Description of Artificial Sequence: Synthetic oligonucleotide
gcggatgatacgttagcgctggcgcgcgcccgtggcgaggcgatgagc

SEQ ID NO: 3397 - DNA, 48 bp, Artificial Sequence
  Description of Artificial Sequence: Synthetic oligonucleotide
ccggatgaattagcccgtcgtgcggcccaagtgattgccgatcgcacc

SEQ ID NO: 3398 - DNA, 48 bp, Artificial Sequence
  Description of Artificial Sequence: Synthetic oligonucleotide
ggccgtgcggttaaccatattaaatctgtttggaaagatttactggaa

SEQ ID NO: 3399 - DNA, 48 bp, Artificial Sequence
  Description of Artificial Sequence: Synthetic oligonucleotide
attaccaaattacgcaccgatctgcgcttcattgcggagctgacgatt

SEQ ID NO: 3400 - DNA, 48 bp, Artificial Sequence
  Description of Artificial Sequence: Synthetic oligonucleotide
gaagtgcgtaacatcgtggataaaacggccagctttgttgcgcgcaat

SEQ ID NO: 3401 - DNA, 48 bp, Artificial Sequence
  Description of Artificial Sequence: Synthetic oligonucleotide
gtggaactgatccacaaagcgtttatcaagggcattaagaatgccacc

SEQ ID NO: 3402 - DNA, 48 bp, Artificial Sequence
  Description of Artificial Sequence: Synthetic oligonucleotide
cgtgaaaaagccttagaactggcgatggcccaaattgataagaatttt

SEQ ID NO: 3403 - DNA, 48 bp, Artificial Sequence
  Description of Artificial Sequence: Synthetic oligonucleotide
ctggtggatcaagagatgaataatgtgtacgagcgtgtgatgaagctg

SEQ ID NO: 3404 - DNA, 48 bp, Artificial Sequence
  Description of Artificial Sequence: Synthetic oligonucleotide
aatagcattaaggacaaatttgaacaagccctgattgaccgtgttaaa

SEQ ID NO: 3405 - DNA, 48 bp, Artificial Sequence
  Description of Artificial Sequence: Synthetic oligonucleotide
cgtcagcatcaagagaaagtgattggttacattaattctgcggagcag

SEQ ID NO: 3406 - DNA, 48 bp, Artificial Sequence
  Description of Artificial Sequence: Synthetic oligonucleotide
gaaaaaaatttagcctatgcgcgtaaggttaaagcggccctggagacc

SEQ ID NO: 3407 - DNA, 48 bp, Artificial Sequence
  Description of Artificial Sequence: Synthetic oligonucleotide
aaagaactgtacgagcatgtgaaacaattaattgcgttacgtaagcag

SEQ ID NO: 3408 - DNA, 48 bp, Artificial Sequence
  Description of Artificial Sequence: Synthetic oligonucleotide
cgtcatcagatgacggacctgctgagcatggacgccctgtatcgccag

SEQ ID NO: 3409 - DNA, 48 bp, Artificial Sequence
  Description of Artificial Sequence: Synthetic oligonucleotide
gtggtggatatggagcaaattatgaccgaaaagttagcgcgtcaagtg

SEQ ID NO: 3410 - DNA, 48 bp, Artificial Sequence
  Description of Artificial Sequence: Synthetic oligonucleotide
gcgtttattcgcgccagccgtgcgttaacggataaagttaccgacctg

SEQ ID NO: 3411 - DNA, 48 bp, Artificial Sequence
  Description of Artificial Sequence: Synthetic oligonucleotide
atgcgtaaagttaagagcgtggtgttattccatcattctgaattactg

SEQ ID NO: 3412 - DNA, 48 bp, Artificial Sequence
  Description of Artificial Sequence: Synthetic oligonucleotide
ccgaaagcggttgagattaccagctacatccgtaaagttctggaggaa

SEQ ID NO: 3413 - DNA, 48 bp, Artificial Sequence
  Description of Artificial Sequence: Synthetic oligonucleotide
ctggcggaaaacgccgataaactgggtatcattctgcgcaatgagctg

SEQ ID NO: 3414 - DNA, 48 bp, Artificial Sequence
  Description of Artificial Sequence: Synthetic oligonucleotide
ggcgaagcggttttagatcatgcgttaacgctgaaaaagggcgagaat

SEQ ID NO: 3415 - DNA, 48 bp, Artificial Sequence
  Description of Artificial Sequence: Synthetic oligonucleotide
ctgggcgatgttttagaacgtgaagcctctgcgcagcaacgtttaggc

SEQ ID NO: 3416 - DNA, 48 bp, Artificial Sequence
  Description of Artificial Sequence: Synthetic oligonucleotide
gtggaaagcatgaacaaggaactgaaaaagatcattggccaagtgcgt

SEQ ID NO: 3417 - DNA, 48 bp, Artificial Sequence
  Description of Artificial Sequence: Synthetic oligonucleotide
gcggaagaacgcaaggcgaccattttagccagcctggcccgttacctg

SEQ ID NO: 3418 - DNA, 48 bp, Artificial Sequence
  Description of Artificial Sequence: Synthetic oligonucleotide
accgatctgatgaacttcctgaaaaccgttcgcagcaccacggaaaaa

SEQ ID NO: 3419 - DNA, 48 bp, Artificial Sequence
  Description of Artificial Sequence: Synthetic oligonucleotide
acccgtgattctggtctggtgattaagacgctggtggacctgttccgt

SEQ ID NO: 3420 - DNA, 48 bp, Artificial Sequence
  Description of Artificial Sequence: Synthetic oligonucleotide
ctggaagatttagttcgtctggtggaggccaaaatttctcgtacgctg

SEQ ID NO: 3421 - DNA, 48 bp, Artificial Sequence
  Description of Artificial Sequence: Synthetic oligonucleotide
caggtgcatgttatccgtgaagtggcctctatggcgaaagagaaactg

SEQ ID NO: 3422 - DNA, 48 bp, Artificial Sequence
  Description of Artificial Sequence: Synthetic oligonucleotide
aaaaccaatttaatggccgaactggaaaagatgaacaaaattatccag

SEQ ID NO: 3423 - DNA, 48 bp, Artificial Sequence
  Description of Artificial Sequence: Synthetic oligonucleotide
ctgaataaagccgttcgtgaaaccgcccacgaaaccatcagcgccatt

SEQ ID NO: 3424 - DNA, 48 bp, Artificial Sequence
  Description of Artificial Sequence: Synthetic oligonucleotide
accaatcattctatcgtgcgtgaatacatcgtgcagtctctgcgcgat

SEQ ID NO: 3425 - DNA, 48 bp, Artificial Sequence
  Description of Artificial Sequence: Synthetic oligonucleotide
cgtgaacgtttcttaaatgcgcgtgacacgctgcgtgccctgttagat

SEQ ID NO: 3426 - DNA, 48 bp, Artificial Sequence
  Description of Artificial Sequence: Synthetic oligonucleotide
cgtaccctggagacgagcgtgaaagacgccctggcgcgcgcgaacgcg

SEQ ID NO: 3427 - DNA, 48 bp, Artificial Sequence
  Description of Artificial Sequence: Synthetic oligonucleotide
gatcagcaggcccgcctgaaactggaggagattgcggccgatatcaaa

SEQ ID NO: 3428 - DNA, 48 bp, Artificial Sequence
  Description of Artificial Sequence: Synthetic oligonucleotide
gaaccgtgggcgcaacgcgtggaagcggccgttcagcgtgttctggat

SEQ ID NO: 3429 - DNA, 48 bp, Artificial Sequence
  Description of Artificial Sequence: Synthetic oligonucleotide
gatgaaaaacaaaaggtggcggtggaggttattaaaaacctgttaacc

SEQ ID NO: 3430 - DNA, 48 bp, Artificial Sequence
  Description of Artificial Sequence: Synthetic oligonucleotide
gtgggcgaattaaacacccgtctgacggacgatgtgtctaaaatcaat

SEQ ID NO: 3431 - DNA, 48 bp, Artificial Sequence
  Description of Artificial Sequence: Synthetic oligonucleotide
gataccgaaaagcgcgattttgtgcgcacggtgctgatcctgaaggaa

SEQ ID NO: 3432 - DNA, 48 bp, Artificial Sequence
  Description of Artificial Sequence: Synthetic oligonucleotide
gaacgtaatttagacctgaaaagcacgatcaaaaccatcattacgagc

SEQ ID NO: 3433 - DNA, 48 bp, Artificial Sequence
  Description of Artificial Sequence: Synthetic oligonucleotide
atggcgaaattaaaccaggaactggagggtaaagtggccgattctctg

SEQ ID NO: 3434 - DNA, 48 bp, Artificial Sequence
  Description of Artificial Sequence: Synthetic oligonucleotide
gatgtggtgaagaacgatgcgcgtgccacggcgagcgcctatttagaa

SEQ ID NO: 3435 - DNA, 48 bp, Artificial Sequence; identical to SEQ ID NO: 1323
  Description of Artificial Sequence: Synthetic oligonucleotide

SEQ ID NO: 3436 - DNA, 48 bp, Artificial Sequence
  Description of Artificial Sequence: Synthetic oligonucleotide
attaccctggagcaagcgaaaaaattagagaaacgtttaaatgaggtg

SEQ ID NO: 3437 - DNA, 48 bp, Artificial Sequence
  Description of Artificial Sequence: Synthetic oligonucleotide
ctgagcgaaatcatcgtggattttcacgacaaaattaagagcatcagc

SEQ ID NO: 3438 - DNA, 48 bp, Artificial Sequence
  Description of Artificial Sequence: Synthetic oligonucleotide
cataaactggacgcccagctgacccaagttctggaacgcgcgcaaaat

SEQ ID NO: 3439 - DNA, 48 bp, Artificial Sequence
  Description of Artificial Sequence: Synthetic oligonucleotide
agcgcggcgaacaaggatgcgattcgcaagcagatggatgccgcggcg

SEQ ID NO: 3440 - DNA, 48 bp, Artificial Sequence
  Description of Artificial Sequence: Synthetic oligonucleotide
aaagaaagcgccatcaaagtgctggagaaggcgattaaggcgtaccag

SEQ ID NO: 3441 - DNA, 48 bp, Artificial Sequence
  Description of Artificial Sequence: Synthetic oligonucleotide
gataaagcgttaaagaccatggtggaaggtttacgtcaggttgcgacc

SEQ ID NO: 3442 - DNA, 48 bp, Artificial Sequence
  Description of Artificial Sequence: Synthetic oligonucleotide
cgtgaaggcaagacggatctgctgcgcatcgtggaaaagtggaaaacc

SEQ ID NO: 3443 - DNA, 48 bp, Artificial Sequence
  Description of Artificial Sequence: Synthetic oligonucleotide
gtgaaagaaacggaccgtattgcggccatggttgatggcttacagaaa

SEQ ID NO: 3444 - DNA, 48 bp, Artificial Sequence
  Description of Artificial Sequence: Synthetic oligonucleotide
agccgtgcggacgccgcggtgaccgacgacgcgcgtggtctgttagcg

SEQ ID NO: 3445 - DNA, 48 bp, Artificial Sequence
  Description of Artificial Sequence: Synthetic oligonucleotide
ccgtatagcgttcgcgcgaaagatttagccgaaaaattaagcaacgaa

SEQ ID NO: 3446 - DNA, 48 bp, Artificial Sequence
  Description of Artificial Sequence: Synthetic oligonucleotide
aaagaactggttgaccagtataaagccgcccaggaagccgcgcgcgtg

SEQ ID NO: 3447 - DNA, 48 bp, Artificial Sequence
  Description of Artificial Sequence: Synthetic oligonucleotide
gaaagcgattggaagatcgcgcgtcagatcggtccgaccttaaaagaa

SEQ ID NO: 3448 - DNA, 48 bp, Artificial Sequence
  Description of Artificial Sequence: Synthetic oligonucleotide
ctgaaactgaaggagattaatgtggttaacgaaattacgaaaatcctg

SEQ ID NO: 3449 - DNA, 48 bp, Artificial Sequence
  Description of Artificial Sequence: Synthetic oligonucleotide
gatgaactgcgcgacaaagtgaatggtgccctgaaaacgctgcgcgaa

SEQ ID NO: 3450 - DNA, 48 bp, Artificial Sequence
  Description of Artificial Sequence: Synthetic oligonucleotide
ccggcgtttatcgttgaagaaagcatcaaggcgcagcgcaaattactg

SEQ ID NO: 3451 - DNA, 48 bp, Artificial Sequence; identical to SEQ ID NO: 1349
  Description of Artificial Sequence: Synthetic oligonucleotide

SEQ ID NO: 3452 - DNA, 48 bp, Artificial Sequence
  Description of Artificial Sequence: Synthetic oligonucleotide
catgaatatcacgccgaaaccattaagaacgtgcgtacggcgacggaa

SEQ ID NO: 3453 - DNA, 48 bp, Artificial Sequence
  Description of Artificial Sequence: Synthetic oligonucleotide
ggcaccgaagccaacgaagcggcgttaaagtttgcgcgcgcgcacacc

SEQ ID NO: 3454 - DNA, 48 bp, Artificial Sequence
  Description of Artificial Sequence: Synthetic oligonucleotide
attagcaccttagactttgaaattcgccaccagctgacgaaaatccat

SEQ ID NO: 3455 - DNA, 48 bp, Artificial Sequence
  Description of Artificial Sequence: Synthetic oligonucleotide
ccgaaatttcgcgaggcggtgaaagccgccagcgatgagctgtctaaa

SEQ ID NO: 3456 - DNA, 48 bp, Artificial Sequence
  Description of Artificial Sequence: Synthetic oligonucleotide
gaaattagcaaggccgtggatgtgtacaacagcctgaaggatcgcctg

SEQ ID NO: 3457 - DNA, 48 bp, Artificial Sequence
  Description of Artificial Sequence: Synthetic oligonucleotide
tttcgtcaggcccacaccgcgagcggtaaggcggtgcacctggccgaa

SEQ ID NO: 3458 - DNA, 48 bp, Artificial Sequence
  Description of Artificial Sequence: Synthetic oligonucleotide
gcgagccagcgcgaggcggcggaacgcgccatgcgtcagcgcgatcgt

SEQ ID NO: 3459 - DNA, 48 bp, Artificial Sequence
  Description of Artificial Sequence: Synthetic oligonucleotide
ccggatcagatcggtgcgaaaggcgttgagaccgcggacaaagttctg

SEQ ID NO: 3460 - DNA, 48 bp, Artificial Sequence
  Description of Artificial Sequence: Synthetic oligonucleotide
agcgaaggcttagcccgtattgatgcctacctgaaaaacgaaatccag

SEQ ID NO: 3461 - DNA, 48 bp, Artificial Sequence
  Description of Artificial Sequence: Synthetic oligonucleotide
aataccgtgaacgttcatattcatcgcatccgtgaaaagctggagaaa

SEQ ID NO: 3462 - DNA, 48 bp, Artificial Sequence
  Description of Artificial Sequence: Synthetic oligonucleotide
ggccaggtgggtcgccagctgaaaatcatcggcgatgacattaaccgt

SEQ ID NO: 3463 - DNA, 48 bp, Artificial Sequence
  Description of Artificial Sequence: Synthetic oligonucleotide
tgggatgtgatccgcgataaaaccaagacgaaaattgagagcttaaaa

SEQ ID NO: 3464 - DNA, 48 bp, Artificial Sequence
  Description of Artificial Sequence: Synthetic oligonucleotide
aaaagccgtttaatcgatcgtgcgtctcaactgctggaggtgatccgt

SEQ ID NO: 3465 - DNA, 48 bp, Artificial Sequence
  Description of Artificial Sequence: Synthetic oligonucleotide
ccgaccgcgaaggccgaactggtgaagttaattaaagccatgcaggaa

SEQ ID NO: 3466 - DNA, 48 bp, Artificial Sequence
  Description of Artificial Sequence: Synthetic oligonucleotide
cgtgatgcgaacgagcgtgtggcggagttcattcgtaacaaaatccgt

SEQ ID NO: 3467 - DNA, 48 bp, Artificial Sequence
  Description of Artificial Sequence: Synthetic oligonucleotide
cgtctgcatacggttatggaacgtctgatggacaagattagcttcagc

SEQ ID NO: 3468 - DNA, 48 bp, Artificial Sequence
  Description of Artificial Sequence: Synthetic oligonucleotide
ccgtatagcaagcaacataccattacgttagcgcgtgagctggccaaa

SEQ ID NO: 3469 - DNA, 48 bp, Artificial Sequence
  Description of Artificial Sequence: Synthetic oligonucleotide
aaactgagcttaaacgtggtgcgtaagttaattgaattactgaaggaa

SEQ ID NO: 3470 - DNA, 48 bp, Artificial Sequence
  Description of Artificial Sequence: Synthetic oligonucleotide
ccgcaggatcgcgccgcgctgctggcccgcgtggatcaactggcccgt

SEQ ID NO: 3471 - DNA, 48 bp, Artificial Sequence
  Description of Artificial Sequence: Synthetic oligonucleotide
ctggaaagcgccttagcgatgctggcggacgcccagcagcgcaaagat

SEQ ID NO: 3472 - DNA, 48 bp, Artificial Sequence
  Description of Artificial Sequence: Synthetic oligonucleotide
aatgaagatttaaagaaactggaagcctctgcgattgagctggccaaa

SEQ ID NO: 3473 - DNA, 48 bp, Artificial Sequence
  Description of Artificial Sequence: Synthetic oligonucleotide
atttttgcgttagcccaggaaattaacgagctggcggagaaagcccgt

SEQ ID NO: 3474 - DNA, 48 bp, Artificial Sequence
  Description of Artificial Sequence: Synthetic oligonucleotide
gaacaggcggttttagcgcagcgtatcgttgataaaatctggcgtgat

SEQ ID NO: 3475 - DNA, 48 bp, Artificial Sequence
  Description of Artificial Sequence: Synthetic oligonucleotide
ccgctgggccaagccctgcgtgcgatcggtgatgaattcgaaacgcgt

SEQ ID NO: 3476 - DNA, 48 bp, Artificial Sequence
  Description of Artificial Sequence: Synthetic oligonucleotide
agcgaaaccgttgaccgtgcgtttggtcaaatgaaagcggccattcgt

SEQ ID NO: 3477 - DNA, 48 bp, Artificial Sequence
  Description of Artificial Sequence: Synthetic oligonucleotide
tttcgtgatttagccctgcgtgtggaccaaattcgtgaccagatggcg

SEQ ID NO: 3478 - DNA, 48 bp, Artificial Sequence
  Description of Artificial Sequence: Synthetic oligonucleotide
agcgcggtgcaaatcaaacgtgaattaaaccatctgttatatcaacgt

SEQ ID NO: 3479 - DNA, 48 bp, Artificial Sequence
  Description of Artificial Sequence: Synthetic oligonucleotide
gcggaagtgaaggagaccctggcgttagccgaagcggccgcgaacaaa

SEQ ID NO: 3480 - DNA, 48 bp, Artificial Sequence
  Description of Artificial Sequence: Synthetic oligonucleotide
aaaaaagatgacgaggtgtttcgtacggccgtgggcgacctgaaccag

SEQ ID NO: 3481 - DNA, 48 bp, Artificial Sequence
  Description of Artificial Sequence: Synthetic oligonucleotide
gatgcggaagttaaccgtgcgaaagcccaactgaaagccgcgttactg

SEQ ID NO: 3482 - DNA, 48 bp, Artificial Sequence
  Description of Artificial Sequence: Synthetic oligonucleotide
aaaagcgaacgcgaggatctgattaagtacctgaaacaagcgacgagc

SEQ ID NO: 3483 - DNA, 48 bp, Artificial Sequence
  Description of Artificial Sequence: Synthetic oligonucleotide
ccgaaaggccaaatggccctgaaatttaaggagctggtggagcagcgt

SEQ ID NO: 3484 - DNA, 48 bp, Artificial Sequence
  Description of Artificial Sequence: Synthetic oligonucleotide
ccggaacaggccttaaatgatgcggttaagattatgaaagagaaaatt

SEQ ID NO: 3485 - DNA, 48 bp, Artificial Sequence
  Description of Artificial Sequence: Synthetic oligonucleotide
agcaaaaatgtttctgatatgattgataaggttcatgaagagatgaaa

SEQ ID NO: 3486 - DNA, 48 bp, Artificial Sequence
  Description of Artificial Sequence: Synthetic oligonucleotide
gcggatgcggttttcgcggaagtgcaccgcgcgaatttaagcaaggcg

SEQ ID NO: 3487 - DNA, 48 bp, Artificial Sequence
  Description of Artificial Sequence: Synthetic oligonucleotide
cagctgagcaagtctatggatgcggtggccgagagcatttacgaaaaa

SEQ ID NO: 3488 - DNA, 48 bp, Artificial Sequence
  Description of Artificial Sequence: Synthetic oligonucleotide
tttgataccgccttaaataccgtgatcgacgcgattgacaaaatccgt

SEQ ID NO: 3489 - DNA, 48 bp, Artificial Sequence
  Description of Artificial Sequence: Synthetic oligonucleotide
gaacagggcgttatgaaggcgtttgaagccgccctgaaagacaccgcg

SEQ ID NO: 3490 - DNA, 48 bp, Artificial Sequence
  Description of Artificial Sequence: Synthetic oligonucleotide
ccggtggaagttgccgaacgtattcgcacggtggtggccgcggagacc

SEQ ID NO: 3491 - DNA, 48 bp, Artificial Sequence
  Description of Artificial Sequence: Synthetic oligonucleotide
ggcgatgcgaagttagcggaagcgaaggccgcggcgcgccagaacctg

SEQ ID NO: 3492 - DNA, 48 bp, Artificial Sequence
  Description of Artificial Sequence: Synthetic oligonucleotide
agcggcaaattcgttaatggcattttagaccgtattgccaaagagcat

SEQ ID NO: 3493 - DNA, 48 bp, Artificial Sequence
  Description of Artificial Sequence: Synthetic oligonucleotide
cagcgtgcgttcgttaaaaatgtggacgccattgaacgcgcgaagggc

SEQ ID NO: 3494 - DNA, 48 bp, Artificial Sequence
  Description of Artificial Sequence: Synthetic oligonucleotide
agccgtgtggagcaagtgctggcggacttaaaaaatttcagcaaggaa

SEQ ID NO: 3495 - DNA, 48 bp, Artificial Sequence
  Description of Artificial Sequence: Synthetic oligonucleotide
aaaacccagatctacgcggtgaaagacaagattgaaacgctgttaatt

SEQ ID NO: 3496 - DNA, 48 bp, Artificial Sequence
  Description of Artificial Sequence: Synthetic oligonucleotide
gatcgtcagaacaaggcgtataaagaggccatggaagcgttaaaagaa

SEQ ID NO: 3497 - DNA, 48 bp, Artificial Sequence
  Description of Artificial Sequence: Synthetic oligonucleotide
aatgaagcggccgacctgattgaaaaggccattaatatggccattcgt

SEQ ID NO: 3498 - DNA, 48 bp, Artificial Sequence
  Description of Artificial Sequence: Synthetic oligonucleotide
gtggcggcgcgctctgatctgctggttgaccagtggaaaaagaaagcg

SEQ ID NO: 3499 - DNA, 48 bp, Artificial Sequence
  Description of Artificial Sequence: Synthetic oligonucleotide
gtgcgtgaagttttcgaaatggcgacccgcgccgcgctgcaagcgcgt

SEQ ID NO: 3500 - DNA, 48 bp, Artificial Sequence
  Description of Artificial Sequence: Synthetic oligonucleotide
gaaaatgatttacaacgtgcgaccgacttagcgtatcgcatggtgagc

SEQ ID NO: 3501 - DNA, 48 bp, Artificial Sequence
  Description of Artificial Sequence: Synthetic oligonucleotide
catgaaaaattaacgcaggcgcgtaaccaactgctggccgaagccgcg

SEQ ID NO: 3502 - DNA, 48 bp, Artificial Sequence
  Description of Artificial Sequence: Synthetic oligonucleotide
ctgggccatcaagttgcgagcgattacttacgtattatggagcgtgcg

SEQ ID NO: 3503 - DNA, 48 bp, Artificial Sequence
  Description of Artificial Sequence: Synthetic oligonucleotide
cgtgataaaatcttaagcgatgtgttagccaaattttctgcggccatt

SEQ ID NO: 3504 - DNA, 48 bp, Artificial Sequence
  Description of Artificial Sequence: Synthetic oligonucleotide
gatattcatcaaatcattgatagcatccaagaaaccaagaaattaaaa

SEQ ID NO: 3505 - DNA, 48 bp, Artificial Sequence
  Description of Artificial Sequence: Synthetic oligonucleotide
cgtgatattatcaacgcgcgtctgcgcgaggaactggacaaaatcacc

SEQ ID NO: 3506 - DNA, 48 bp, Artificial Sequence
  Description of Artificial Sequence: Synthetic oligonucleotide
attggcaaaatcacgcgtaccgtgtctgactatgtgcaagaagcccgt

SEQ ID NO: 3507 - DNA, 48 bp, Artificial Sequence
  Description of Artificial Sequence: Synthetic oligonucleotide
gaaaatgtgcacgcccgtattgaaggtttcaaaagcgccctggacgtg

SEQ ID NO: 3508 - DNA, 48 bp, Artificial Sequence
  Description of Artificial Sequence: Synthetic oligonucleotide
aaacaggcggtttctatgtttctgggcgccgttgaagaagccaaaaaa

SEQ ID NO: 3509 - DNA, 48 bp, Artificial Sequence
  Description of Artificial Sequence: Synthetic oligonucleotide
ccggatgaaatgcgcaaggaagtgctgatgcaattactgaatgttaaa

SEQ ID NO: 3510 - DNA, 48 bp, Artificial Sequence
  Description of Artificial Sequence: Synthetic oligonucleotide
catcgtgaagccgttgaacattttttagaggcgctgaacatgcagcgt

SEQ ID NO: 3511 - DNA, 48 bp, Artificial Sequence
  Description of Artificial Sequence: Synthetic oligonucleotide
cgtgtgccggagcaaaaactgggcgccgccattgatgagtttgccagc

SEQ ID NO: 3512 - DNA, 48 bp, Artificial Sequence
  Description of Artificial Sequence: Synthetic oligonucleotide
ggcgatcaggccgaccgttatgcggttaagctgctgaaccatttacgt

SEQ ID NO: 3513 - DNA, 48 bp, Artificial Sequence
  Description of Artificial Sequence: Synthetic oligonucleotide
attagctatgttcaaggcgaacgtcaagcccgtaatgttctgcgcgaa

SEQ ID NO: 3514 - DNA, 48 bp, Artificial Sequence
  Description of Artificial Sequence: Synthetic oligonucleotide
gataaatttttacaagataaaaaattattaattagcatcctggagaaa

SEQ ID NO: 3515 - DNA, 48 bp, Artificial Sequence
  Description of Artificial Sequence: Synthetic oligonucleotide
gcggaaggccaagcctatcgtgataacgttgcgcgtatcattaagaat

SEQ ID NO: 3516 - DNA, 48 bp, Artificial Sequence
  Description of Artificial Sequence: Synthetic oligonucleotide
gaaggcgatttattcacccagctgcgcaagattgtgaagatggcgagc

SEQ ID NO: 3517 - DNA, 48 bp, Artificial Sequence
  Description of Artificial Sequence: Synthetic oligonucleotide
ctggatgaattagttaaagaaaccaagaagaaaattatcgatacgctg

SEQ ID NO: 3518 - DNA, 48 bp, Artificial Sequence
  Description of Artificial Sequence: Synthetic oligonucleotide
ccggcgaccgttgttaccgcgctggagcaactggcgcaccatcaccat

SEQ ID NO: 3519 - DNA, 48 bp, Artificial Sequence
  Description of Artificial Sequence: Synthetic oligonucleotide
gcgcgtgaaatggccaacgcgaaagaaatcgcccgtaccgttcagatt

SEQ ID NO: 3520 - DNA, 48 bp, Artificial Sequence
  Description of Artificial Sequence: Synthetic oligonucleotide
gtggaactgggtcgccagctgggcgccgcctatcagcgcctggacgat

SEQ ID NO: 3521 - DNA, 48 bp, Artificial Sequence
  Description of Artificial Sequence: Synthetic oligonucleotide
cgtgatgaattaaaggcgctgattcaaaaggtgacccacaatttagtg

SEQ ID NO: 3522 - DNA, 48 bp, Artificial Sequence
  Description of Artificial Sequence: Synthetic oligonucleotide
cgtagcgaattatctgatctgggcacgttaattaaagacaatttaaaa

SEQ ID NO: 3523 - DNA, 48 bp, Artificial Sequence
  Description of Artificial Sequence: Synthetic oligonucleotide
gtgcaggatttaggtagcaccgtgatcaaggaagtgttaaaacgcgcg

SEQ ID NO: 3524 - DNA, 48 bp, Artificial Sequence
  Description of Artificial Sequence: Synthetic oligonucleotide
attattccgcgcacgctgcatcagatcttcgaaaaattaaccgacaat

SEQ ID NO: 3525 - DNA, 48 bp, Artificial Sequence
  Description of Artificial Sequence: Synthetic oligonucleotide
accaatgaattaaaggaaattgtgcgcaagattggcaaggatttaagc

SEQ ID NO: 3526 - DNA, 48 bp, Artificial Sequence
  Description of Artificial Sequence: Synthetic oligonucleotide
ccgaccattcgcgagcgtattgaagccatgacggcggaagccagcaaa

SEQ ID NO: 3527 - DNA, 48 bp, Artificial Sequence
  Description of Artificial Sequence: Synthetic oligonucleotide
caggaagcgcgcttaggcattaaaccacacattcagcgcctgttagat

SEQ ID NO: 3528 - DNA, 48 bp, Artificial Sequence
  Description of Artificial Sequence: Synthetic oligonucleotide
accgcggatcgcgacattctggcgcgcttacataaagccgtgacgagc

SEQ ID NO: 3529 - DNA, 48 bp, Artificial Sequence
  Description of Artificial Sequence: Synthetic oligonucleotide
gatggcgaattaaacctgatgaaaaaagccgccagcattacgagcgaa

SEQ ID NO: 3530 - DNA, 48 bp, Artificial Sequence
  Description of Artificial Sequence: Synthetic oligonucleotide
accgatgcgatcaaccgtggcaatgagcgcctgctgcgctatttacag

SEQ ID NO: 3531 - DNA, 48 bp, Artificial Sequence
  Description of Artificial Sequence: Synthetic oligonucleotide
cgtgaaaaagccttagaactggcggttgcccagattgagaaatcttat

SEQ ID NO: 3532 - DNA, 48 bp, Artificial Sequence
  Description of Artificial Sequence: Synthetic oligonucleotide
ggcgatgtgaaggtttggatgcagaatctggaggacctgcatacgcgt

SEQ ID NO: 3533 - DNA, 48 bp, Artificial Sequence
  Description of Artificial Sequence: Synthetic oligonucleotide
gaaaattttacgcaacgtgtgagcacgaacctggaaaagatgaaacag

SEQ ID NO: 3534 - DNA, 48 bp, Artificial Sequence
  Description of Artificial Sequence: Synthetic oligonucleotide
catgcggcgggtgaccgtatgctgcaggaggttgcgacccgcctgagc

SEQ ID NO: 3535 - DNA, 48 bp, Artificial Sequence
  Description of Artificial Sequence: Synthetic oligonucleotide
aaaaccgatcgcatcaaactggaacaagttattagcggtgcgttaaaa

SEQ ID NO: 3536 - DNA, 48 bp, Artificial Sequence
  Description of Artificial Sequence: Synthetic oligonucleotide
gaaaaaagccgcgagtttgcggaaaagttaaatcgtgaggcgcgcgat

SEQ ID NO: 3537 - DNA, 48 bp, Artificial Sequence
  Description of Artificial Sequence: Synthetic oligonucleotide
agcgcgaatacgaagcgtgtgatggatatcttcctgaaaatcaatgaa

SEQ ID NO: 3538 - DNA, 48 bp, Artificial Sequence
  Description of Artificial Sequence: Synthetic oligonucleotide
cgtcaggaattagagctgagcgtgaagaaggaactggagaaaatcctg

SEQ ID NO: 3539 - DNA, 48 bp, Artificial Sequence
  Description of Artificial Sequence: Synthetic oligonucleotide
agcgaacatttagccaaaatgctgagcaagcacctggaacgcgtgatt

SEQ ID NO: 3540 - DNA, 48 bp, Artificial Sequence
  Description of Artificial Sequence: Synthetic oligonucleotide
gtgtttgaaacgttaaaagaagtgtctcgcctggtgttagcgcgcgtg

SEQ ID NO: 3541 - DNA, 48 bp, Artificial Sequence
  Description of Artificial Sequence: Synthetic oligonucleotide
gatagcgtgaagatcgaagcggcgaagttaaaaaaatcttttttaacc

SEQ ID NO: 3542 - DNA, 48 bp, Artificial Sequence
  Description of Artificial Sequence: Synthetic oligonucleotide
ccgaccgcgcgcgagcgtaccaccggtgccgtggatgccctgaaggcg

SEQ ID NO: 3543 - DNA, 48 bp, Artificial Sequence
  Description of Artificial Sequence: Synthetic oligonucleotide
tttaaacagttagttgaagatctggaccgcattctgacgctgacgacc

SEQ ID NO: 3544 - DNA, 48 bp, Artificial Sequence
  Description of Artificial Sequence: Synthetic oligonucleotide
accggcgcgatgatcacgggcaccatggtggacgagctggaacgccgt

SEQ ID NO: 3545 - DNA, 48 bp, Artificial Sequence
  Description of Artificial Sequence: Synthetic oligonucleotide
gaaaccgtgttagagagctatcgtacgaacagcctgcgcaaaatcaat

SEQ ID NO: 3546 - DNA, 48 bp, Artificial Sequence
  Description of Artificial Sequence: Synthetic oligonucleotide
gatctggaaaaggccaaaacccatttagttgtgctgtgggccagccag

SEQ ID NO: 3547 - DNA, 48 bp, Artificial Sequence
  Description of Artificial Sequence: Synthetic oligonucleotide
aaacgtaccttaaaccgttatgaaaagatcgcgaatgacattgacgcg

SEQ ID NO: 3548 - DNA, 48 bp, Artificial Sequence
  Description of Artificial Sequence: Synthetic oligonucleotide
gataaagcggccttcgcggcgcagaagcaaaaagcggacgcgttactg

SEQ ID NO: 3549 - DNA, 48 bp, Artificial Sequence
  Description of Artificial Sequence: Synthetic oligonucleotide
caggcgctgaaggactatgaagcgcacttagcgagcttaggccgcagc

SEQ ID NO: 3550 - DNA, 48 bp, Artificial Sequence
  Description of Artificial Sequence: Synthetic oligonucleotide
ccgaaaaccgttaacgaaatgattgatgccttcaccaaagcccgtgat

SEQ ID NO: 3551 - DNA, 48 bp, Artificial Sequence
  Description of Artificial Sequence: Synthetic oligonucleotide
gcgggcctgtctgagaaagtggatcgcttacatagctacctgaaccgt

SEQ ID NO: 3552 - DNA, 48 bp, Artificial Sequence
  Description of Artificial Sequence: Synthetic oligonucleotide
catcagggcgttgccattgataccttcgccaaagaagttgaaaagcgt

SEQ ID NO: 3553 - DNA, 48 bp, Artificial Sequence
  Description of Artificial Sequence: Synthetic oligonucleotide
gtggaaaaatctgttgaaaccctgttagacctgattatgaagcgtatg

SEQ ID NO: 3554 - DNA, 48 bp, Artificial Sequence
  Description of Artificial Sequence: Synthetic oligonucleotide
ccgaaagaaatccaaattcagattcgcaagtttgtgggtgaattaatt

SEQ ID NO: 3555 - DNA, 48 bp, Artificial Sequence
  Description of Artificial Sequence: Synthetic oligonucleotide
gatgatgtgaagaagctggcggaagagacggaagcgcgcattaagagc

SEQ ID NO: 3556 - DNA, 48 bp, Artificial Sequence
  Description of Artificial Sequence: Synthetic oligonucleotide
gatgatctgatggaggccgcggcgaaacgcttcaaagaacaagtgagc

SEQ ID NO: 3557 - DNA, 48 bp, Artificial Sequence
  Description of Artificial Sequence: Synthetic oligonucleotide
atgcgtaatcacgccaaaaccgatcgcgtttttgatttagcggcccgt

SEQ ID NO: 3558 - DNA, 48 bp, Artificial Sequence
  Description of Artificial Sequence: Synthetic oligonucleotide
gcgcgtcatatgcgcgagctgctgacccaaatgggtcatctgtacggc

SEQ ID NO: 3559 - DNA, 48 bp, Artificial Sequence
  Description of Artificial Sequence: Synthetic oligonucleotide
ccgtataattctcgcgcggatgaattagcccgtctggccattaaggaa

SEQ ID NO: 3560 - DNA, 48 bp, Artificial Sequence
  Description of Artificial Sequence: Synthetic oligonucleotide
accgatctgatcaagcgtattggccaagccaccgcgaaggaagttgcg

SEQ ID NO: 3561 - DNA, 48 bp, Artificial Sequence
  Description of Artificial Sequence: Synthetic oligonucleotide
ccgtatggccgcgaccgtgatggccaagttgcggcggccctgaagacc

SEQ ID NO: 3562 - DNA, 48 bp, Artificial Sequence
  Description of Artificial Sequence: Synthetic oligonucleotide
aaagaactggttttacgtattctgacggttcgtgaaaacctggccgaa

SEQ ID NO: 3563 - DNA, 48 bp, Artificial Sequence
  Description of Artificial Sequence: Synthetic oligonucleotide
aaaaataccgccgaccaggtggcggttgaggcgatgcgtgagcgtatg

SEQ ID NO: 3564 - DNA, 48 bp, Artificial Sequence
  Description of Artificial Sequence: Synthetic oligonucleotide
gcgaaaggccaacaagaagcggcgcgcgccggcgaattactgaaggaa

SEQ ID NO: 3565 - DNA, 48 bp, Artificial Sequence
  Description of Artificial Sequence: Synthetic oligonucleotide
gatgtgctgtactctctgagcaaaacgttaaaagatgcccgtgacaaa

SEQ ID NO: 3566 - DNA, 48 bp, Artificial Sequence
  Description of Artificial Sequence: Synthetic oligonucleotide
ctgaccgaattaaacagcctgatttctcgcctggcggacgatacgaaa

SEQ ID NO: 3567 - DNA, 48 bp, Artificial Sequence
  Description of Artificial Sequence: Synthetic oligonucleotide
ggcaccaaagttacgaaaatggaagatgacatcaaaaaattactgggc

SEQ ID NO: 3568 - DNA, 48 bp, Artificial Sequence
  Description of Artificial Sequence: Synthetic oligonucleotide
ggcctgcagcgcgccaaaaccggcacggacaaaaccttagtgaaggaa

SEQ ID NO: 3569 - DNA, 48 bp, Artificial Sequence
  Description of Artificial Sequence: Synthetic oligonucleotide
ccggaaaaaacgaaggcggtggaaaactacctgattcaaatggcgcgt

SEQ ID NO: 3570 - DNA, 48 bp, Artificial Sequence
  Description of Artificial Sequence: Synthetic oligonucleotide
gatgaaaaaacggccattaccaaaggttacgaagcgttaattaagcgt

SEQ ID NO: 3571 - DNA, 48 bp, Artificial Sequence
  Description of Artificial Sequence: Synthetic oligonucleotide
gcggaagtgtacgacattattaaaaaggagagcaatcgccagcgcgtg

SEQ ID NO: 3572 - DNA, 48 bp, Artificial Sequence
  Description of Artificial Sequence: Synthetic oligonucleotide
gcggcgcgtacggttcgtgcgcagttacgcgaatggctggccgaaatt

SEQ ID NO: 3573 - DNA, 48 bp, Artificial Sequence
  Description of Artificial Sequence: Synthetic oligonucleotide
gtgagcagcatccgcgatgcggatcgcgttattggcttactggagagc

SEQ ID NO: 3574 - DNA, 48 bp, Artificial Sequence
  Description of Artificial Sequence: Synthetic oligonucleotide
agcgcggaagccgttaaaaaaaccgccgaggatctggccaaagagctg

SEQ ID NO: 3575 - DNA, 48 bp, Artificial Sequence
  Description of Artificial Sequence: Synthetic oligonucleotide
aatgcggtgtctttagtgatgcgtcgtatccgcaaagaaaacgtggat

SEQ ID NO: 3576 - DNA, 48 bp, Artificial Sequence
  Description of Artificial Sequence: Synthetic oligonucleotide
ctgagccagcacgagcgttatgtggagcaactgaaacaagcgttaaaa

SEQ ID NO: 3577 - DNA, 48 bp, Artificial Sequence
  Description of Artificial Sequence: Synthetic oligonucleotide
gaagcggatatgaagcgcgtggtgctgtctttagtgaccatgttacat

SEQ ID NO: 3578 - DNA, 48 bp, Artificial Sequence
  Description of Artificial Sequence: Synthetic oligonucleotide
ccggaagcgatcaaccgtggcaatgagcgcctgctgcgctatttacag

SEQ ID NO: 3579 - DNA, 48 bp, Artificial Sequence
  Description of Artificial Sequence: Synthetic oligonucleotide
gaaaaaacccgcgacgcggcgctgatcttagcgcagaaggcgcacgcg

SEQ ID NO: 3580 - DNA, 48 bp, Artificial Sequence
  Description of Artificial Sequence: Synthetic oligonucleotide
aaaaatgaattagttcagcgtctgatcaaggatgatgaggaatctaaa

SEQ ID NO: 3581 - DNA, 48 bp, Artificial Sequence
  Description of Artificial Sequence: Synthetic oligonucleotide
atttttgaacgcttaaccagcgaattattaggcgtgatggccaaaaaa

SEQ ID NO: 3582 - DNA, 48 bp, Artificial Sequence
  Description of Artificial Sequence: Synthetic oligonucleotide
atggaagaaatgcgcaaggaaattattgccgttattcagaagtatacc

SEQ ID NO: 3583 - DNA, 48 bp, Artificial Sequence
  Description of Artificial Sequence: Synthetic oligonucleotide
ctggatgatgttgactttattaataagcgcattaccgttctggccaat

SEQ ID NO: 3584 - DNA, 48 bp, Artificial Sequence
  Description of Artificial Sequence: Synthetic oligonucleotide
attgcgacccgcaagaaatgggtgagcttagttgaaggcgttaaagaa

SEQ ID NO: 3585 - DNA, 48 bp, Artificial Sequence
  Description of Artificial Sequence: Synthetic oligonucleotide
cgtgcggaattagacgcgctgctgacgcaagcggcgttatttaagcgt

SEQ ID NO: 3586 - DNA, 48 bp, Artificial Sequence
  Description of Artificial Sequence: Synthetic oligonucleotide
gcgcaggaattagacattaaagcgcgcaactttctgatcaataagaaa

SEQ ID NO: 3587 - DNA, 48 bp, Artificial Sequence
  Description of Artificial Sequence: Synthetic oligonucleotide
gaaaaaagcatcttaggcgcgaaagaggccctgagcatcctgaaccgt

SEQ ID NO: 3588 - DNA, 48 bp, Artificial Sequence
  Description of Artificial Sequence: Synthetic oligonucleotide
aatgaactgcgcgaggcgctgaataaggcctttgcggagatgcgtgcg

SEQ ID NO: 3589 - DNA, 48 bp, Artificial Sequence
  Description of Artificial Sequence: Synthetic oligonucleotide
gataaaggcttccaaaaagtgattgccgacatgagcggcccacatgtg

SEQ ID NO: 3590 - DNA, 48 bp, Artificial Sequence
  Description of Artificial Sequence: Synthetic oligonucleotide
ctgagctatcgcgaggcggtgctgcgcgccgtggatcgcctgaacgaa

SEQ ID NO: 3591 - DNA, 48 bp, Artificial Sequence
  Description of Artificial Sequence: Synthetic oligonucleotide
catctgagcggtgacgaagtgctgaagacggtgagcaagcgtatcctg

SEQ ID NO: 3592 - DNA, 48 bp, Artificial Sequence
  Description of Artificial Sequence: Synthetic oligonucleotide
accgaactgaagaagattaccgataagacgattaaagcctttatggat

SEQ ID NO: 3593 - DNA, 48 bp, Artificial Sequence
  Description of Artificial Sequence: Synthetic oligonucleotide
tttcgtgatttagccctgcgtgtggaccaaattcgtgacaatatggcg

SEQ ID NO: 3594 - DNA, 48 bp, Artificial Sequence
  Description of Artificial Sequence: Synthetic oligonucleotide
gtgcaggatatcgagcgtgcggtggccaagctggcgcaaaaattaaaa

SEQ ID NO: 3595 - DNA, 48 bp, Artificial Sequence
  Description of Artificial Sequence: Synthetic oligonucleotide
gtggaaattggtgagaaaattgcgcaaatcgcgattgaccgtgccagc

SEQ ID NO: 3596 - DNA, 48 bp, Artificial Sequence
  Description of Artificial Sequence: Synthetic oligonucleotide
gcgcatacctacatcgcggcgaaaaagatcgaaaatgaggcgaagaaa

SEQ ID NO: 3597 - DNA, 48 bp, Artificial Sequence
  Description of Artificial Sequence: Synthetic oligonucleotide
gaagaaaccttaatcaatcatgcgaaggcctgggcgagcgccattcgt

SEQ ID NO: 3598 - DNA, 48 bp, Artificial Sequence
  Description of Artificial Sequence: Synthetic oligonucleotide
cgtgcggaacgccgcgaagtggaaaacgttgtggtgacggcgttagcg

SEQ ID NO: 3599 - DNA, 48 bp, Artificial Sequence
  Description of Artificial Sequence: Synthetic oligonucleotide
accaatctgacgaagctggaagtgttattagaaatttctgataagctg

SEQ ID NO: 3600 - DNA, 48 bp, Artificial Sequence
  Description of Artificial Sequence: Synthetic oligonucleotide
ccggaatttcgcgagaaagcgctgaaggccatggaaaccgagcgtcag

SEQ ID NO: 3601 - DNA, 48 bp, Artificial Sequence
  Description of Artificial Sequence: Synthetic oligonucleotide
gatgcgattaaccaaaaagcgcaggagttagcgcgtaaggcggttgcg

SEQ ID NO: 3602 - DNA, 48 bp, Artificial Sequence
  Description of Artificial Sequence: Synthetic oligonucleotide
ccgcgtgaattattaattgcgcgtcaagccgcgaatgttattgagcat

SEQ ID NO: 3603 - DNA, 48 bp, Artificial Sequence
  Description of Artificial Sequence: Synthetic oligonucleotide
caggaagaagccttagaactgattaacggttatattcaaaaaatcaaa

SEQ ID NO: 3604 - DNA, 48 bp, Artificial Sequence
  Description of Artificial Sequence: Synthetic oligonucleotide
gatgaacgtaaccgccagattgcggagatcggcgcgtctctgatcaaa

SEQ ID NO: 3605 - DNA, 48 bp, Artificial Sequence
  Description of Artificial Sequence: Synthetic oligonucleotide
ctgaaagaagccatggacctgggcaccgaggccgcgaaatacgtgagc

SEQ ID NO: 3606 - DNA, 48 bp, Artificial Sequence
  Description of Artificial Sequence: Synthetic oligonucleotide
gcgcatattcaacacgataaaaccacgtctgcgctgaagattttaagc

SEQ ID NO: 3607 - DNA, 48 bp, Artificial Sequence
  Description of Artificial Sequence: Synthetic oligonucleotide
gcgagcctgaaggagtttctgaaatctttactggaagccattatcaaa

SEQ ID NO: 3608 - DNA, 48 bp, Artificial Sequence
  Description of Artificial Sequence: Synthetic oligonucleotide
agcgaaaccgttgaccgtgcgttttctcaaatgaaagcggccattcgt

SEQ ID NO: 3609 - DNA, 48 bp, Artificial Sequence
  Description of Artificial Sequence: Synthetic oligonucleotide
cgtgaaaatttcgagattctgatgaaattaaaggaaagcttagaactg

SEQ ID NO: 3610 - DNA, 48 bp, Artificial Sequence
  Description of Artificial Sequence: Synthetic oligonucleotide
ccgcagctggcccacgatcgtattacggaggcggcgcgccaggttcgt

SEQ ID NO: 3611 - DNA, 48 bp, Artificial Sequence
  Description of Artificial Sequence: Synthetic oligonucleotide
gcgccgtatcgcaaggaacagcgtttacgcgaagtgttaagcggtctg

SEQ ID NO: 3612 - DNA, 48 bp, Artificial Sequence
  Description of Artificial Sequence: Synthetic oligonucleotide
cgtcaggaagttcaagataccgcgcgcggtcagattaacgattacatt

SEQ ID NO: 3613 - DNA, 48 bp, Artificial Sequence
  Description of Artificial Sequence: Synthetic oligonucleotide
atgaccctggccaagaccgaagcgaagttactgcatgagaaaatcagc

SEQ ID NO: 3614 - DNA, 48 bp, Artificial Sequence
  Description of Artificial Sequence: Synthetic oligonucleotide
agcgatctggtttacgaaaccattaaccgcgtgaaacgcattaaggat

SEQ ID NO: 3615 - DNA, 48 bp, Artificial Sequence
  Description of Artificial Sequence: Synthetic oligonucleotide
cgtcgtaaattcgaggaagtggatacgaacctgaaagttctgttacat

SEQ ID NO: 3616 - DNA, 48 bp, Artificial Sequence
  Description of Artificial Sequence: Synthetic oligonucleotide
ctggatcgtttacgccagtttattggtgagctggcgacgctgttagat

SEQ ID NO: 3617 - DNA, 48 bp, Artificial Sequence
  Description of Artificial Sequence: Synthetic oligonucleotide
gtgagcaaaatgaacgacatggtgaaactggttgagaaactgttagcg

SEQ ID NO: 3618 - DNA, 48 bp, Artificial Sequence
  Description of Artificial Sequence: Synthetic oligonucleotide
ggcggcgaagccaaggcggtggaaacgttaaaacagcaaattcaaaaa

SEQ ID NO: 3619 - DNA, 48 bp, Artificial Sequence
  Description of Artificial Sequence: Synthetic oligonucleotide
aaagaagatgttgacgtggcggtggccgccgcgaaaacggcgttaacc

SEQ ID NO: 3620 - DNA, 48 bp, Artificial Sequence
  Description of Artificial Sequence: Synthetic oligonucleotide
gcgaccgatgtttctaaacgtctggacttagcggtgcgcctgttaatt

SEQ ID NO: 3621 - DNA, 48 bp, Artificial Sequence
  Description of Artificial Sequence: Synthetic oligonucleotide
cgtgaagaagccatcagcaatatggtggttgccctgaaagagctgagc

SEQ ID NO: 3622 - DNA, 48 bp, Artificial Sequence
  Description of Artificial Sequence: Synthetic oligonucleotide
gcggtgattgagatgacgaaaaaagtgaagccacatctggttgcgagc

SEQ ID NO: 3623 - DNA, 48 bp, Artificial Sequence
  Description of Artificial Sequence: Synthetic oligonucleotide
gcggtgattgagatgacgcagaaaaccaaggagcatctgatcaaaacc

SEQ ID NO: 3624 - DNA, 48 bp, Artificial Sequence
  Description of Artificial Sequence: Synthetic oligonucleotide
ctgagcgcggccgagcatctgctgaaggcccaggaacacctgatcggc

SEQ ID NO: 3625 - DNA, 48 bp, Artificial Sequence
  Description of Artificial Sequence: Synthetic oligonucleotide
gataatgatcgcgcctttaccattaagaagctggcggagctggttaaa

SEQ ID NO: 3626 - DNA, 48 bp, Artificial Sequence
  Description of Artificial Sequence: Synthetic oligonucleotide
aaagaagaacacacggaactggtgaaggacctgattgccaaattaaat

SEQ ID NO: 3627 - DNA, 48 bp, Artificial Sequence
  Description of Artificial Sequence: Synthetic oligonucleotide
acccagcattgggttttagaaggcattgagcgcgcggtgaaggaagcg

SEQ ID NO: 3628 - DNA, 48 bp, Artificial Sequence
  Description of Artificial Sequence: Synthetic oligonucleotide
ggcgatagccaagacaccgcgtataaggttagccagttagcggaccgt

SEQ ID NO: 3629 - DNA, 48 bp, Artificial Sequence
  Description of Artificial Sequence: Synthetic oligonucleotide
ggcgcgcgtttagccgaatatcatgccaaggcgaccgagcatttaagc

SEQ ID NO: 3630 - DNA, 48 bp, Artificial Sequence
  Description of Artificial Sequence: Synthetic oligonucleotide
tataaaaaacgcttaaatgaactgatcacggatgcgttaattacgagc

SEQ ID NO: 3631 - DNA, 48 bp, Artificial Sequence
  Description of Artificial Sequence: Synthetic oligonucleotide
cgtcaggaagccttagaactgattaagaagggctatacgcagcaactg

SEQ ID NO: 3632 - DNA, 48 bp, Artificial Sequence
  Description of Artificial Sequence: Synthetic oligonucleotide
agcgtgcgtatgcgcgccattcagaatcgcttactgcatgagctgggc

SEQ ID NO: 3633 - DNA, 48 bp, Artificial Sequence
  Description of Artificial Sequence: Synthetic oligonucleotide
agcgaaccgttattacatctgcgtgagaagattgcgcgcctggttacc

SEQ ID NO: 3634 - DNA, 48 bp, Artificial Sequence
  Description of Artificial Sequence: Synthetic oligonucleotide
cgtggccatcaaaagctgattaatgccacggtggaaaaggcgcgcgaa

SEQ ID NO: 3635 - DNA, 48 bp, Artificial Sequence
  Description of Artificial Sequence: Synthetic oligonucleotide
ctggaaagctctcacgcgctggcgcacgccctgaaaatgatgcgcgaa

SEQ ID NO: 3636 - DNA, 48 bp, Artificial Sequence
  Description of Artificial Sequence: Synthetic oligonucleotide
aaacagaccgagtctcatgcggtgaagatcgtggtggaggcggcccgt

SEQ ID NO: 3637 - DNA, 48 bp, Artificial Sequence
  Description of Artificial Sequence: Synthetic oligonucleotide
ccggaagatatgttagagcagtttaaaacggttcgtgcgttaattcgt

SEQ ID NO: 3638 - DNA, 48 bp, Artificial Sequence
  Description of Artificial Sequence: Synthetic oligonucleotide
gaagatgatgttaagagcctgagccgcgttatgattcatgtttttagc

SEQ ID NO: 3639 - DNA, 48 bp, Artificial Sequence
  Description of Artificial Sequence: Synthetic oligonucleotide
gcgtatgcggacgttattgtgaattctgccctggaaaagctgcgcaaa

SEQ ID NO: 3640 - DNA, 48 bp, Artificial Sequence
  Description of Artificial Sequence: Synthetic oligonucleotide
atttatgaacacttacagaaactggttcaagcggaattaaaattaatt

SEQ ID NO: 3641 - DNA, 48 bp, Artificial Sequence
  Description of Artificial Sequence: Synthetic oligonucleotide
aaagatgcgttcttactgattcagcgcttaacccgtatcattttacat

SEQ ID NO: 3642 - DNA, 48 bp, Artificial Sequence
  Description of Artificial Sequence: Synthetic oligonucleotide
gaacagggcaaccgcgaagcgcgtcaagccggccagttactgaaggaa

SEQ ID NO: 3643 - DNA, 48 bp, Artificial Sequence
  Description of Artificial Sequence: Synthetic oligonucleotide
caggcgaccttagacaaactggaagccggttttaaaaagctgcaagaa

SEQ ID NO: 3644 - DNA, 48 bp, Artificial Sequence
  Description of Artificial Sequence: Synthetic oligonucleotide
gcggtgatttacttaattagccataagttagtgaaaaagagcttagat

SEQ ID NO: 3645 - DNA, 48 bp, Artificial Sequence
  Description of Artificial Sequence: Synthetic oligonucleotide
cgtgtgcataagatcaataatgtgaacaaggcgctggactttatcgcg

SEQ ID NO: 3646 - DNA, 48 bp, Artificial Sequence
  Description of Artificial Sequence: Synthetic oligonucleotide
tttgataccgccttaaccgatctgaagacgattattcgcgcggagcgt

SEQ ID NO: 3647 - DNA, 48 bp, Artificial Sequence
  Description of Artificial Sequence: Synthetic oligonucleotide
gatggcacccaacgcggcgcgctggttatcagccaggaggcgaagcgt

SEQ ID NO: 3648 - DNA, 48 bp, Artificial Sequence
  Description of Artificial Sequence: Synthetic oligonucleotide
gatgcgcagaagatcgcgattgataagttatttagcatgttaaaagat

SEQ ID NO: 3649 - DNA, 48 bp, Artificial Sequence
  Description of Artificial Sequence: Synthetic oligonucleotide
aatcatgtgaacgaggcgctgaaagccttaaaacagatcaaagaggaa

SEQ ID NO: 3650 - DNA, 48 bp, Artificial Sequence
  Description of Artificial Sequence: Synthetic oligonucleotide
gaacgtgatcgcacgcatagcattatcaagggcattaaggatcgcacc

SEQ ID NO: 3651 - DNA, 48 bp, Artificial Sequence
  Description of Artificial Sequence: Synthetic oligonucleotide
aaacaggtgggtgccctgaaaagcatggttgaggataaaatccagaaa

SEQ ID NO: 3652 - DNA, 48 bp, Artificial Sequence
  Description of Artificial Sequence: Synthetic oligonucleotide
gtgtatggcaagacgaaactggcgggtgagaaagcgttacaggacaat

SEQ ID NO: 3653 - DNA, 48 bp, Artificial Sequence
  Description of Artificial Sequence: Synthetic oligonucleotide
agcgaagcggccaaccagcgtctggaggccggcaaatctgcggttgaa

SEQ ID NO: 3654 - DNA, 48 bp, Artificial Sequence
  Description of Artificial Sequence: Synthetic oligonucleotide
aaagaacaggttcaagcgagcctggagaacatggcgaaagttgtggat

SEQ ID NO: 3655 - DNA, 48 bp, Artificial Sequence
  Description of Artificial Sequence: Synthetic oligonucleotide
caggaaacccaaaagggcgcgctgaaggagattcaggcctttatccgt

SEQ ID NO: 3656 - DNA, 48 bp, Artificial Sequence
  Description of Artificial Sequence: Synthetic oligonucleotide
ccgcgtgcgaagaaggtgctggaattatctctgcgtgagggcttacag

SEQ ID NO: 3657 - DNA, 48 bp, Artificial Sequence
  Description of Artificial Sequence: Synthetic oligonucleotide
aaactgcattctcaagcgaatctgatgcgcttaaaaagcgacctgttt

SEQ ID NO: 3658 - DNA, 48 bp, Artificial Sequence
  Description of Artificial Sequence: Synthetic oligonucleotide
ggcgaagcgtacaagcagcaggtggcccgcgcggtggccgaaatccgt

SEQ ID NO: 3659 - DNA, 48 bp, Artificial Sequence
  Description of Artificial Sequence: Synthetic oligonucleotide
aaagaagatttcggtaaactgatgaccaagaaccatgaattactgaaa

SEQ ID NO: 3660 - DNA, 48 bp, Artificial Sequence
  Description of Artificial Sequence: Synthetic oligonucleotide
aaagaagcggcctctgtgacccgtgaccacatggtgatggtgggtacc

SEQ ID NO: 3661 - DNA, 48 bp, Artificial Sequence
  Description of Artificial Sequence: Synthetic oligonucleotide
cgtaccgaagccgccaatgtggaaaagatcaccaccaagctgttaaaa

SEQ ID NO: 3662 - DNA, 48 bp, Artificial Sequence
  Description of Artificial Sequence: Synthetic oligonucleotide
gtgggcgatgacttcagccgtgtggttaaccgtcagttagatcaaacc

SEQ ID NO: 3663 - DNA, 48 bp, Artificial Sequence
  Description of Artificial Sequence: Synthetic oligonucleotide
gcgggcgaacgcatcgtggatattatcgccaccgatatccagacgaaa

SEQ ID NO: 3664 - DNA, 48 bp, Artificial Sequence
  Description of Artificial Sequence: Synthetic oligonucleotide
gtgggcgatgccatcagcgcgctgtctcgcaaaattgccaaagagacc

SEQ ID NO: 3665 - DNA, 48 bp, Artificial Sequence
  Description of Artificial Sequence: Synthetic oligonucleotide
cgtcaggcgatcttcgaaaccctggttgccaaaggccgcgaattactg

SEQ ID NO: 3666 - DNA, 48 bp, Artificial Sequence
  Description of Artificial Sequence: Synthetic oligonucleotide
agcgtgggcgccaagaccctgaaatctgttattaaagagtataacgaa

SEQ ID NO: 3667 - DNA, 48 bp, Artificial Sequence
  Description of Artificial Sequence: Synthetic oligonucleotide
attgatctgcaaaaggaagtggaagccttactggataagcagatcaaa

SEQ ID NO: 3668 - DNA, 48 bp, Artificial Sequence
  Description of Artificial Sequence: Synthetic oligonucleotide
aatgcgagcgaccgcctgctggaaatcatgcgcctgtatcaaaaacag

SEQ ID NO: 3669 - DNA, 48 bp, Artificial Sequence
  Description of Artificial Sequence: Synthetic oligonucleotide
attgatgcggcccacaaagaaattacggacggcgtggccaatttcaaa

SEQ ID NO: 3670 - DNA, 48 bp, Artificial Sequence
  Description of Artificial Sequence: Synthetic oligonucleotide
gatgaatggaaaaacaagctggatagcttaatcgatcgtatcattaaa

SEQ ID NO: 3671 - DNA, 48 bp, Artificial Sequence
  Description of Artificial Sequence: Synthetic oligonucleotide
ggccgtgaatctgttggctttctggttacgattaaagagctgttagaa

SEQ ID NO: 3672 - DNA, 48 bp, Artificial Sequence
  Description of Artificial Sequence: Synthetic oligonucleotide
gtggaaaaagttttaaaaacccgttaccacgatgcgacgagcaagctg

SEQ ID NO: 3673 - DNA, 48 bp, Artificial Sequence
  Description of Artificial Sequence: Synthetic oligonucleotide
ccgaaagtgatcaaccgtctggcgcacgaggtgattgaggcgcaacag

SEQ ID NO: 3674 - DNA, 48 bp, Artificial Sequence
  Description of Artificial Sequence: Synthetic oligonucleotide
agcctggcggagatgggtgcgaatcgtttatggaagctgattcacgaa

SEQ ID NO: 3675 - DNA, 48 bp, Artificial Sequence
  Description of Artificial Sequence: Synthetic oligonucleotide
cgtaatgattaccgcaccctgcgtcaaggtattattgacatggtgctg

SEQ ID NO: 3676 - DNA, 48 bp, Artificial Sequence
  Description of Artificial Sequence: Synthetic oligonucleotide
gtgcgtggccgcttagcggaaaccttattaattctgaaggaaaacttt

SEQ ID NO: 3677 - DNA, 48 bp, Artificial Sequence
  Description of Artificial Sequence: Synthetic oligonucleotide
ctgggccgtgagaaggcggtgcaggaggccattcgtgacctgatccag

SEQ ID NO: 3678 - DNA, 48 bp, Artificial Sequence
  Description of Artificial Sequence: Synthetic oligonucleotide
agcccgcgtgagacgctgaccgatacgatcatgatggcgaaaatccgt

SEQ ID NO: 3679 - DNA, 48 bp, Artificial Sequence
  Description of Artificial Sequence: Synthetic oligonucleotide
ggcccggataacttacgtaaaggcatcgagctggcggttgcggagacc

SEQ ID NO: 3680 - DNA, 48 bp, Artificial Sequence
  Description of Artificial Sequence: Synthetic oligonucleotide
cgtgaaaccttagagattagctatcgcaacgcgattgcccgtttaagc

SEQ ID NO: 3681 - DNA, 48 bp, Artificial Sequence
  Description of Artificial Sequence: Synthetic oligonucleotide
ccggcggattgggccaagaaactgaccgacgccgtgctgcgccagaaa

SEQ ID NO: 3682 - DNA, 48 bp, Artificial Sequence
  Description of Artificial Sequence: Synthetic oligonucleotide
attagcaccttagactttgaaattcgccaccagctgacgcagatccat

SEQ ID NO: 3683 - DNA, 48 bp, Artificial Sequence
  Description of Artificial Sequence: Synthetic oligonucleotide
aaaaccgtgaacatgatggagctgattaataacatcgcgaaagagcat

SEQ ID NO: 3684 - DNA, 48 bp, Artificial Sequence
  Description of Artificial Sequence: Synthetic oligonucleotide
cagcatctgcacacgctgctggatttatacgataaaatcaatacgaaa

SEQ ID NO: 3685 - DNA, 48 bp, Artificial Sequence
  Description of Artificial Sequence: Synthetic oligonucleotide
aaaccgcaggttttcgcgaatgcggagaagattgtggagcagttaaaa

SEQ ID NO: 3686 - DNA, 48 bp, Artificial Sequence
  Description of Artificial Sequence: Synthetic oligonucleotide
ccggatcagcaacgcgattttcagcgcgagattcagatcctgaaggcg

SEQ ID NO: 3687 - DNA, 48 bp, Artificial Sequence
  Description of Artificial Sequence: Synthetic oligonucleotide
ctggaaggcttattaagccagatgaaagccatcgatgatttagtgaaa

SEQ ID NO: 3688 - DNA, 48 bp, Artificial Sequence
  Description of Artificial Sequence: Synthetic oligonucleotide
tttgaaaccaacgttcgtgaaaccaagcgcgtggtggaggcggcccat

SEQ ID NO: 3689 - DNA, 48 bp, Artificial Sequence
  Description of Artificial Sequence: Synthetic oligonucleotide
ccggatgatacggcccgtattctgcgcgagtttctgtctgatgcccgt

SEQ ID NO: 3690 - DNA, 48 bp, Artificial Sequence
  Description of Artificial Sequence: Synthetic oligonucleotide
gaagcgcgtcaacgcctggtggaagcccaaattaaagaggcggttctg

SEQ ID NO: 3691 - DNA, 48 bp, Artificial Sequence
  Description of Artificial Sequence: Synthetic oligonucleotide
aaaaccgaattattacgtgcggtggccgaccgtattttactgtctgcg

SEQ ID NO: 3692 - DNA, 48 bp, Artificial Sequence
  Description of Artificial Sequence: Synthetic oligonucleotide
ccggatcataaggccacccgtgatgccacgctgctggccgcgcgcgaa

SEQ ID NO: 3693 - DNA, 48 bp, Artificial Sequence
  Description of Artificial Sequence: Synthetic oligonucleotide
attagcaccttagactttaaaattcgccaccagctgacgcagacgcat

SEQ ID NO: 3694 - DNA, 48 bp, Artificial Sequence
  Description of Artificial Sequence: Synthetic oligonucleotide
aaaagcaaaaagttagaatttctgttaaaggtgagcgaccgtttagaa

SEQ ID NO: 3695 - DNA, 48 bp, Artificial Sequence
  Description of Artificial Sequence: Synthetic oligonucleotide
gcgagcctggttaagagccgtctggagcacgaactgggtcgtatccgt

SEQ ID NO: 3696 - DNA, 48 bp, Artificial Sequence
  Description of Artificial Sequence: Synthetic oligonucleotide
tttgtggaaaacgccattattaaagcccgccatgcggccaaacaaacc

SEQ ID NO: 3697 - DNA, 48 bp, Artificial Sequence
  Description of Artificial Sequence: Synthetic oligonucleotide
ctggcggcgcgcaaggattttcagcgcgaggcggaattactgacgaat

SEQ ID NO: 3698 - DNA, 48 bp, Artificial Sequence
  Description of Artificial Sequence: Synthetic oligonucleotide
aatcagcgtgccgccattgtggaaaagaagattgaattagcgaagacc

SEQ ID NO: 3699 - DNA, 48 bp, Artificial Sequence
  Description of Artificial Sequence: Synthetic oligonucleotide
gatgaagcggttgccaaatttagcacggccattaatgagctgaaggcg

SEQ ID NO: 3700 - DNA, 48 bp, Artificial Sequence
  Description of Artificial Sequence: Synthetic oligonucleotide
gatagcacccgcgagaccgtgctgaagcaaattcgtgagtttttagaa

SEQ ID NO: 3701 - DNA, 48 bp, Artificial Sequence
  Description of Artificial Sequence: Synthetic oligonucleotide
gaaatggaacgcgagcagctggaagttttaaaacagcgcggcatcgcg

SEQ ID NO: 3702 - DNA, 48 bp, Artificial Sequence
  Description of Artificial Sequence: Synthetic oligonucleotide
atggatgaacgcaaccgtcagattgccgagattggcgccagcttaatt

SEQ ID NO: 3703 - DNA, 48 bp, Artificial Sequence
  Description of Artificial Sequence: Synthetic oligonucleotide
gcgctgaatgagaagctggtgaaagagacgctgcagttagcggagcag

SEQ ID NO: 3704 - DNA, 48 bp, Artificial Sequence
  Description of Artificial Sequence: Synthetic oligonucleotide
cgtgatgaattagttgaaaaagtgaacaagaccctggccaaacgcctg

SEQ ID NO: 3705 - DNA, 48 bp, Artificial Sequence
  Description of Artificial Sequence: Synthetic oligonucleotide
aaagaagcgaagaacgcggcggcgaagttagcggtggagattttaaat

SEQ ID NO: 3706 - DNA, 48 bp, Artificial Sequence
  Description of Artificial Sequence: Synthetic oligonucleotide
gcggatgcgatgaaccgcgaagtgagctctttaaaaaataagctgcgt

SEQ ID NO: 3707 - DNA, 48 bp, Artificial Sequence
  Description of Artificial Sequence: Synthetic oligonucleotide
catcgtctgatcgaccaggcgaccgccgagattgtggagaccgccaaa

SEQ ID NO: 3708 - DNA, 48 bp, Artificial Sequence
  Description of Artificial Sequence: Synthetic oligonucleotide
ccgaaatttaagaagattctgagcttaatggaccatgtggaggaacag

SEQ ID NO: 3709 - DNA, 48 bp, Artificial Sequence
  Description of Artificial Sequence: Synthetic oligonucleotide
caggcggcggcctctgaatggcgtgcgcgcgttgtggatgccctgaaa

SEQ ID NO: 3710 - DNA, 48 bp, Artificial Sequence
  Description of Artificial Sequence: Synthetic oligonucleotide
acccagggcgttaagcgtatgaatggcttcatccaggcgcaccgtgaa

SEQ ID NO: 3711 - DNA, 48 bp, Artificial Sequence
  Description of Artificial Sequence: Synthetic oligonucleotide
gtggcgaatgccgttcagaaaattaagggtattgtggagaccgagcat

SEQ ID NO: 3712 - DNA, 48 bp, Artificial Sequence
  Description of Artificial Sequence: Synthetic oligonucleotide
atggatagcaagaagtatgtgcagttaaagcataaagccgcggccgaa

SEQ ID NO: 3713 - DNA, 48 bp, Artificial Sequence
  Description of Artificial Sequence: Synthetic oligonucleotide
agcaaaaccggtgagaaaattatgcagttattaaaaaaattaaatgaa

SEQ ID NO: 3714 - DNA, 48 bp, Artificial Sequence
  Description of Artificial Sequence: Synthetic oligonucleotide
cgtaccgaattaaaggaaattgtgacgtctgatctgaagcagttactg

SEQ ID NO: 3715 - DNA, 48 bp, Artificial Sequence
  Description of Artificial Sequence: Synthetic oligonucleotide
ggccgtgtggttttagatgaagcggttaagctgctgaagcaggccagc

SEQ ID NO: 3716 - DNA, 48 bp, Artificial Sequence
  Description of Artificial Sequence: Synthetic oligonucleotide
cgtgaactgatggagacgggccgtagcgttgttcagaaatacctgaat

SEQ ID NO: 3717 - DNA, 48 bp, Artificial Sequence
  Description of Artificial Sequence: Synthetic oligonucleotide
caggaactggagttaagcctgaatatggccttcgcgcgtgcccgtgaa

SEQ ID NO: 3718 - DNA, 48 bp, Artificial Sequence
  Description of Artificial Sequence: Synthetic oligonucleotide
ccgcaggtggacaaggtgcgtgaagccacggaaattgccaccggtctg

SEQ ID NO: 3719 - DNA, 48 bp, Artificial Sequence
  Description of Artificial Sequence: Synthetic oligonucleotide
ggccatgaaaagttaacccaggcgcgcaaccagctgttagcggaggcg

SEQ ID NO: 3720 - DNA, 48 bp, Artificial Sequence
  Description of Artificial Sequence: Synthetic oligonucleotide
ctggaaaaaacgcgcgaactgaaagaggttctgaataaggtgaagtat

SEQ ID NO: 3721 - DNA, 48 bp, Artificial Sequence
  Description of Artificial Sequence: Synthetic oligonucleotide
ccgctgaccgttaagaaacatctgcgcgcccaggcgatcgcgttagaa

SEQ ID NO: 3722 - DNA, 48 bp, Artificial Sequence
  Description of Artificial Sequence: Synthetic oligonucleotide
aatcagctgcaaaacggcattaaacgcgttaaagaattcctggagagc

SEQ ID NO: 3723 - DNA, 48 bp, Artificial Sequence
  Description of Artificial Sequence: Synthetic oligonucleotide
agcaccgtggccgagaaaagcctgacggagctgctgaagagcttacat

SEQ ID NO: 3724 - DNA, 48 bp, Artificial Sequence
  Description of Artificial Sequence: Synthetic oligonucleotide
gatacccatcgccgcctggtgatggaaacgttaattaaagccggcgat

SEQ ID NO: 3725 - DNA, 48 bp, Artificial Sequence
  Description of Artificial Sequence: Synthetic oligonucleotide
gaaaatgtgaagaagaaactgagcttagccctggaagccgcgaagatg

SEQ ID NO: 3726 - DNA, 48 bp, Artificial Sequence
  Description of Artificial Sequence: Synthetic oligonucleotide
gcggatctggttaagtttggccagcgcttacgtgaattacgtacggcg

SEQ ID NO: 3727 - DNA, 48 bp, Artificial Sequence
  Description of Artificial Sequence: Synthetic oligonucleotide
ggcccgaaagttcgcacctggctgagcgagaacggcgaagagcgtctg

SEQ ID NO: 3728 - DNA, 48 bp, Artificial Sequence
  Description of Artificial Sequence: Synthetic oligonucleotide
agcattattcgcgacctgaccgatgccgccgtgaaaatggttcgtgtg

SEQ ID NO: 3729 - DNA, 48 bp, Artificial Sequence
  Description of Artificial Sequence: Synthetic oligonucleotide
cgtgaagcggccgttgaacagctgaagtctattcgtgaggatatcgtg

SEQ ID NO: 3730 - DNA, 51 bp, Artificial Sequence
  Description of Artificial Sequence: Synthetic oligonucleotide
gcgaaaggccaacaagaagcggcgcgcgccggcgaattactgaaggaaaaa

SEQ ID NO: 3731 - DNA, 51 bp, Artificial Sequence
  Description of Artificial Sequence: Synthetic oligonucleotide
gatgaacatgccgttgaagcggtgcgcggtggccagtacattttacagcgt

SEQ ID NO: 3732 - DNA, 51 bp, Artificial Sequence
  Description of Artificial Sequence: Synthetic oligonucleotide
cgtgatgcgggtcaactgtatagcaagggtatggaaagcttaaaagttatg

SEQ ID NO: 3733 - DNA, 51 bp, Artificial Sequence
  Description of Artificial Sequence: Synthetic oligonucleotide
accgcgattatcgaccagattctgaagttacgtctggagaaagccaaactg

SEQ ID NO: 3734 - DNA, 51 bp, Artificial Sequence
  Description of Artificial Sequence: Synthetic oligonucleotide
tttgaaaccgttcgcagcgcggcgaagacgattcgtgaggcgttagatgcg

SEQ ID NO: 3735 - DNA, 51 bp, Artificial Sequence
  Description of Artificial Sequence: Synthetic oligonucleotide
ctggcggaagcccaagcggattttttaacgcgtgtgttacagcgcctggaa

SEQ ID NO: 3736 - DNA, 51 bp, Artificial Sequence
  Description of Artificial Sequence: Synthetic oligonucleotide
agcgcggcgatccgcgaaatgctgggccacttcagcgatgccaatcaaaaa

SEQ ID NO: 3737 - DNA, 51 bp, Artificial Sequence
  Description of Artificial Sequence: Synthetic oligonucleotide
cgtaccggcacgttcattgtgattgacatcctgattgacattatccgtgaa

SEQ ID NO: 3738 - DNA, 51 bp, Artificial Sequence
  Description of Artificial Sequence: Synthetic oligonucleotide
aatgaaacccgcaagagcctgattgccggtcatatgaccgagattatgcag

SEQ ID NO: 3739 - DNA, 51 bp, Artificial Sequence
  Description of Artificial Sequence: Synthetic oligonucleotide
agcggcgaacgcgaccgtacccattctatcattaaaggtattaaggatcgt

SEQ ID NO: 3740 - DNA, 51 bp, Artificial Sequence
  Description of Artificial Sequence: Synthetic oligonucleotide
tttaaacagttagttgaagcgctggacaaggtgctgttagcggttagcgaa

SEQ ID NO: 3741 - DNA, 51 bp, Artificial Sequence
  Description of Artificial Sequence: Synthetic oligonucleotide
agcgaagtggacatccagggcagcatggcctacgcgaaagccctggagaaa

SEQ ID NO: 3742 - DNA, 51 bp, Artificial Sequence
  Description of Artificial Sequence: Synthetic oligonucleotide
agcctgctgaagcgcacctgggaacaggccgttaaaggcttaaatgagagc

SEQ ID NO: 3743 - DNA, 51 bp, Artificial Sequence
  Description of Artificial Sequence: Synthetic oligonucleotide
ccggtggatcaagccaccctgaccgccttccgtgatatgcgcgcggcccat

SEQ ID NO: 3744 - DNA, 51 bp, Artificial Sequence
  Description of Artificial Sequence: Synthetic oligonucleotide
gcgagcgaacgcggtcgtctgctgaaccgcctggcggacctgatcgaacgt

SEQ ID NO: 3745 - DNA, 51 bp, Artificial Sequence
  Description of Artificial Sequence: Synthetic oligonucleotide
gatcgtgaaaaggccctggaactggccgttgcgcagatcgaaaagagctat

SEQ ID NO: 3746 - DNA, 51 bp, Artificial Sequence
  Description of Artificial Sequence: Synthetic oligonucleotide
ccggatcgtgagaaggcgctggaattagccgtggcgcaaattgagaaaagc

SEQ ID NO: 3747 - DNA, 51 bp, Artificial Sequence
  Description of Artificial Sequence: Synthetic oligonucleotide
ggcgaaaccaagacgaaatatgatgccatgaagaaagataacgtggagagc

SEQ ID NO: 3748 - DNA, 51 bp, Artificial Sequence
  Description of Artificial Sequence: Synthetic oligonucleotide
aaagcggaattacaaaaagcggcgcaagacgcgaaagccgcgtacgaagcg

SEQ ID NO: 3749 - DNA, 51 bp, Artificial Sequence
  Description of Artificial Sequence: Synthetic oligonucleotide
ctggaagcggttatggacgcgattcgtacgacggtgacccactgggtgaaa

SEQ ID NO: 3750 - DNA, 51 bp, Artificial Sequence
  Description of Artificial Sequence: Synthetic oligonucleotide
gtgaaagaaacggttgaagcgatgcgtgttgttgaagcgacgctgtctgcg

SEQ ID NO: 3751 - DNA, 51 bp, Artificial Sequence
  Description of Artificial Sequence: Synthetic oligonucleotide
gtgagcaccaacgttaccaccgcggagcgcctggtgcgcgcggcccataaa

SEQ ID NO: 3752 - DNA, 51 bp, Artificial Sequence
  Description of Artificial Sequence: Synthetic oligonucleotide
gcgaccctggaggccgaatataatttagagcgtgcgcaaaaagccgtgaat

SEQ ID NO: 3753 - DNA, 51 bp, Artificial Sequence
  Description of Artificial Sequence: Synthetic oligonucleotide
gcggcgcaggttaaggatgcgctgacgaagatgcgtgcggccgcgttagat

SEQ ID NO: 3754 - DNA, 51 bp, Artificial Sequence
  Description of Artificial Sequence: Synthetic oligonucleotide
gcgagcgataagttatgggtgacccgtgttatcgcgcatgagctggcccat

SEQ ID NO: 3755 - DNA, 51 bp, Artificial Sequence
  Description of Artificial Sequence: Synthetic oligonucleotide
gcggaaaaattattcaatcaggatgttgacgcggcggttcgtggtattctg

SEQ ID NO: 3756 - DNA, 51 bp, Artificial Sequence
  Description of Artificial Sequence: Synthetic oligonucleotide
attcaggaacacatcaatcgtctggttgccattcgtgcccaggccgatatt

SEQ ID NO: 3757 - DNA, 51 bp, Artificial Sequence
  Description of Artificial Sequence: Synthetic oligonucleotide
aaagcggaatctgacgcggcgtatgagcgccaggcgcgcaaaatcctggaa

SEQ ID NO: 3758 - DNA, 51 bp, Artificial Sequence
  Description of Artificial Sequence: Synthetic oligonucleotide
ggcaccgatttaatgaactttctgaaaacggttcgtagcacgaccgagaaa

SEQ ID NO: 3759 - DNA, 51 bp, Artificial Sequence
  Description of Artificial Sequence: Synthetic oligonucleotide
aatgatgaaatgaaggccgtggcggatgcctacaaacaggttctgaaggat

SEQ ID NO: 3760 - DNA, 51 bp, Artificial Sequence
  Description of Artificial Sequence: Synthetic oligonucleotide
aaagaaagcgttgaggcgatgattattgccggtaaaagcgccaatgagcat

SEQ ID NO: 3761 - DNA, 51 bp, Artificial Sequence
  Description of Artificial Sequence: Synthetic oligonucleotide
tgggataaaacgggtgatattctggccgaggcggcgttaggcttacagcgt

SEQ ID NO: 3762 - DNA, 51 bp, Artificial Sequence
  Description of Artificial Sequence: Synthetic oligonucleotide
agcgcggcgcgcgagcgtggcgaaggtttccagcaggccgtggccgcgcat

SEQ ID NO: 3763 - DNA, 51 bp, Artificial Sequence
  Description of Artificial Sequence: Synthetic oligonucleotide
gcgaaagaagccttagaacaggcgcgccaaaatgtggagaaaacggcggaa

SEQ ID NO: 3764 - DNA, 51 bp, Artificial Sequence
  Description of Artificial Sequence: Synthetic oligonucleotide
atgctggcgtactctgaaatgattgcggagaaggtgcgtacggcggcccgt

SEQ ID NO: 3765 - DNA, 51 bp, Artificial Sequence
  Description of Artificial Sequence: Synthetic oligonucleotide
catgaatatcacgccgaaaccattaagaacgtgcgtacggcgacggaaagc

SEQ ID NO: 3766 - DNA, 51 bp, Artificial Sequence
  Description of Artificial Sequence: Synthetic oligonucleotide
cgtgaaaccgttcgcgtgatggcggaagtttctgcgctggaggcgacggcg

SEQ ID NO: 3767 - DNA, 51 bp, Artificial Sequence
  Description of Artificial Sequence: Synthetic oligonucleotide
accaccgaattaacgatgattgcgaatcgcatccgtgaattaatggaagcg

SEQ ID NO: 3768 - DNA, 51 bp, Artificial Sequence
  Description of Artificial Sequence: Synthetic oligonucleotide
cgtggcaaagttgagcgtagcattaagatcgtggatgagtatttaagcgcg

SEQ ID NO: 3769 - DNA, 51 bp, Artificial Sequence
  Description of Artificial Sequence: Synthetic oligonucleotide
gcgaaagaaatcgcccagctggtgcaagactatacccaacataacggccgt

SEQ ID NO: 3770 - DNA, 51 bp, Artificial Sequence
  Description of Artificial Sequence: Synthetic oligonucleotide
ggcccggatggtgacgcggtggtgtctttagcgaaagagtattctaaaacc

SEQ ID NO: 3771 - DNA, 51 bp, Artificial Sequence
  Description of Artificial Sequence: Synthetic oligonucleotide
gtggcggcgttaatcgcggaacgtgagcgcgtgaccacgagcttaaatgat

SEQ ID NO: 3772 - DNA, 51 bp, Artificial Sequence
  Description of Artificial Sequence: Synthetic oligonucleotide
ctgcatctggttgacctggcgcgtttcgccgtgaccgagcataacaaaaaa

SEQ ID NO: 3773 - DNA, 51 bp, Artificial Sequence
  Description of Artificial Sequence: Synthetic oligonucleotide
agcgcggcgcgcgagcgtggcgaaggtttcaaacaggccattgaggcgcat

SEQ ID NO: 3774 - DNA, 51 bp, Artificial Sequence
  Description of Artificial Sequence: Synthetic oligonucleotide
cgtgaacaggttgttgtgcgtctgttagacatgctgaccaaggcggccagc

SEQ ID NO: 3775 - DNA, 51 bp, Artificial Sequence
  Description of Artificial Sequence: Synthetic oligonucleotide
caggcggtggttcaaaaaagcctggccgccattgcggacgattctaaaaaa

SEQ ID NO: 3776 - DNA, 51 bp, Artificial Sequence
  Description of Artificial Sequence: Synthetic oligonucleotide
atggatgaacgcaaccgtcagattgccgagattggcgccagcttaattaaa

SEQ ID NO: 3777 - DNA, 51 bp, Artificial Sequence
  Description of Artificial Sequence: Synthetic oligonucleotide
cgtcatgtggactacgtggcggatcaaatcgtgaccaagctggttgatgtg

SEQ ID NO: 3778 - DNA, 51 bp, Artificial Sequence
  Description of Artificial Sequence: Synthetic oligonucleotide
gcggtggatcaacgccgtgcggcgcgcacgggcatggcgttcgaaatgctg

SEQ ID NO: 3779 - DNA, 51 bp, Artificial Sequence
  Description of Artificial Sequence: Synthetic oligonucleotide
gcggtgctggacgactggctgaaacagaagggtctgaaaaaccaggccctg

SEQ ID NO: 3780 - DNA, 51 bp, Artificial Sequence
  Description of Artificial Sequence: Synthetic oligonucleotide
cagcagctggttacggatattattcacttagcgcgtgttgcgcgcgatagc

SEQ ID NO: 3781 - DNA, 51 bp, Artificial Sequence
  Description of Artificial Sequence: Synthetic oligonucleotide
aatgcggtgtctttagtgatgcgtcgtatccgcaaagaaaacgtggacgcg

SEQ ID NO: 3782 - DNA, 51 bp, Artificial Sequence
  Description of Artificial Sequence: Synthetic oligonucleotide
cgtgaactgacggagaaagcgttttctttagtgaaattagcgttacgtgat

SEQ ID NO: 3783 - DNA, 51 bp, Artificial Sequence
  Description of Artificial Sequence: Synthetic oligonucleotide
aaagatagcttaggtgaaaccgcgttcaacatgctgctggaccgtatcgtg

SEQ ID NO: 3784 - DNA, 51 bp, Artificial Sequence
  Description of Artificial Sequence: Synthetic oligonucleotide
ctggaaaaaaacttccaggcggcgaagaacatgattgaacgcgcgggtgaa

SEQ ID NO: 3785 - DNA, 51 bp, Artificial Sequence
  Description of Artificial Sequence: Synthetic oligonucleotide
gcgaatctgacggccacctatcgtaagttagaagaaatggccaaacaagtg

SEQ ID NO: 3786 - DNA, 51 bp, Artificial Sequence
  Description of Artificial Sequence: Synthetic oligonucleotide
gatagcggcatcaagcgtattgcggaggccgcgtggcaggttaatgagagc

SEQ ID NO: 3787 - DNA, 51 bp, Artificial Sequence
  Description of Artificial Sequence: Synthetic oligonucleotide
gcggcggaacgcggtcgtgtgctgatgcgcttaagcgcgcgcgtgacggat

SEQ ID NO: 3788 - DNA, 51 bp, Artificial Sequence
  Description of Artificial Sequence: Synthetic oligonucleotide
aaaccgcagttagacaaagtgctgggtttcgtggcgcaagcgaagaaagaa

SEQ ID NO: 3789 - DNA, 51 bp, Artificial Sequence
  Description of Artificial Sequence: Synthetic oligonucleotide
gataaagatcgcgccaatctgattaacaacatttttgagctggccggcctg

SEQ ID NO: 3790 - DNA, 51 bp, Artificial Sequence
  Description of Artificial Sequence: Synthetic oligonucleotide
ccgctggcgatccacgcgctgctggagcgcatgaatgaacaaaaagccaaa

SEQ ID NO: 3791 - DNA, 51 bp, Artificial Sequence
  Description of Artificial Sequence: Synthetic oligonucleotide
cagtgggtgaaggacgcgatgcagcatttagaccgtcaggccgcggccctg

SEQ ID NO: 3792 - DNA, 51 bp, Artificial Sequence
  Description of Artificial Sequence: Synthetic oligonucleotide
gcgcgtcatcgcgagctggcggcgggtatcgaagcgtgggccacccaacat

SEQ ID NO: 3793 - DNA, 51 bp, Artificial Sequence
  Description of Artificial Sequence: Synthetic oligonucleotide
agcaccaatgagtctgtgaaaaatttattactggaacgcgtgaaggaaagc

SEQ ID NO: 3794 - DNA, 51 bp, Artificial Sequence
  Description of Artificial Sequence: Synthetic oligonucleotide
cgtaataatatgcaacacgtggcgggcatcacggaagcggccaaagagacc

SEQ ID NO: 3795 - DNA, 51 bp, Artificial Sequence
  Description of Artificial Sequence: Synthetic oligonucleotide
gaagaacatttcaaggtgctggtgaagatgacggcgcaggagctggccaat

SEQ ID NO: 3796 - DNA, 51 bp, Artificial Sequence
  Description of Artificial Sequence: Synthetic oligonucleotide
agcgcggaacgcatccgtcagctgaagacggtgctgggtaaaatgcaagaa

SEQ ID NO: 3797 - DNA, 51 bp, Artificial Sequence
  Description of Artificial Sequence: Synthetic oligonucleotide
gaaaccctgaagttagaaaccgcgaaggccattctgcacggcttccagacc

SEQ ID NO: 3798 - DNA, 51 bp, Artificial Sequence
  Description of Artificial Sequence: Synthetic oligonucleotide
ctgagcctgttaatgaagaatgcggatacggccatgtatcatgccaaagaa

SEQ ID NO: 3799 - DNA, 51 bp, Artificial Sequence
  Description of Artificial Sequence: Synthetic oligonucleotide
tatgcggatgttgagctgaatagccgcaaggtggcggccggcttacataaa

SEQ ID NO: 3800 - DNA, 51 bp, Artificial Sequence
  Description of Artificial Sequence: Synthetic oligonucleotide
gaaaccgatgagtaccagctgctgcaagttaaaaaattaattgccctgagc

SEQ ID NO: 3801 - DNA, 51 bp, Artificial Sequence
  Description of Artificial Sequence: Synthetic oligonucleotide
gtggtgctggccgagaaagcgcagcaaatcgcgaaaatcctggttaaagaa

SEQ ID NO: 3802 - DNA, 51 bp, Artificial Sequence
  Description of Artificial Sequence: Synthetic oligonucleotide
gaaagcctggttatggccggcgatctggttatcaaaaccgccaaaaagcat

SEQ ID NO: 3803 - DNA, 51 bp, Artificial Sequence
  Description of Artificial Sequence: Synthetic oligonucleotide
aaagaaggcgtttacggcctggcgcgcacgctgctgcacctggcccaggaa

SEQ ID NO: 3804 - DNA, 51 bp, Artificial Sequence
  Description of Artificial Sequence: Synthetic oligonucleotide
gtgcaggatcgcgccgcgctgattcacaagattgcggacggcatccaggcg

SEQ ID NO: 3805 - DNA, 51 bp, Artificial Sequence
  Description of Artificial Sequence: Synthetic oligonucleotide
gaagcgagcatcgccattagccaggcccgcctggatgagaaaatcgcgcag

SEQ ID NO: 3806 - DNA, 51 bp, Artificial Sequence
  Description of Artificial Sequence: Synthetic oligonucleotide
aaagaacagaaggccgaactggtgttaaacgcgctggttgcgatccgttat

SEQ ID NO: 3807 - DNA, 51 bp, Artificial Sequence
  Description of Artificial Sequence: Synthetic oligonucleotide
ccgctggaagagaagaccattcgtgccgttgcgcgtgcccatcacgaaacc

SEQ ID NO: 3808 - DNA, 51 bp, Artificial Sequence
  Description of Artificial Sequence: Synthetic oligonucleotide
gcggatatgcgttctcaacgtgcgcagttagccaaaggcgtttttgaccgt

SEQ ID NO: 3809 - DNA, 51 bp, Artificial Sequence
  Description of Artificial Sequence: Synthetic oligonucleotide
accgatctgcgcatcgcgtttattgccgaggtgcgtaaggtggccaatgaa

SEQ ID NO: 3810 - DNA, 51 bp, Artificial Sequence
  Description of Artificial Sequence: Synthetic oligonucleotide
ggcaaacaggcctctgaagtgtttgccgttctgattaacaaagacaaagcg

SEQ ID NO: 3811 - DNA, 51 bp, Artificial Sequence
  Description of Artificial Sequence: Synthetic oligonucleotide
aatcaggtgttaaacaaagtgaaagccgacaaaagcttagaagccaataat

SEQ ID NO: 3812 - DNA, 51 bp, Artificial Sequence
  Description of Artificial Sequence: Synthetic oligonucleotide
ctggcgcaggttcgcgaagaagtgacggccaaatatgccgaattaaaagcg

SEQ ID NO: 3813 - DNA, 51 bp, Artificial Sequence
  Description of Artificial Sequence: Synthetic oligonucleotide
gtggaagaaaagacggaactgtttaacgttgtggtgtctctgatccgtgcg

SEQ ID NO: 3814 - DNA, 51 bp, Artificial Sequence
  Description of Artificial Sequence: Synthetic oligonucleotide
atggatgaattaaaccgtcagattgccgagattggcgccagcttaattaaa

SEQ ID NO: 3815 - DNA, 51 bp, Artificial Sequence
  Description of Artificial Sequence: Synthetic oligonucleotide
catgaatatcaccaaaccaccattaacaacgtgcgtcaagcggccgcggaa

SEQ ID NO: 3816 - DNA, 51 bp, Artificial Sequence
  Description of Artificial Sequence: Synthetic oligonucleotide
ggcgaacgtatcaagaaaattgtgaacgacattctgggtggcaagaatgcg

SEQ ID NO: 3817 - DNA, 51 bp, Artificial Sequence
  Description of Artificial Sequence: Synthetic oligonucleotide
ctggaaccgttcttagcgcagatgaaagccttagatgatttaattaagagc

SEQ ID NO: 3818 - DNA, 51 bp, Artificial Sequence
  Description of Artificial Sequence: Synthetic oligonucleotide
atgaaacagacggagagccatgcggttaagattgtggttgaagccgcgcgt

SEQ ID NO: 3819 - DNA, 51 bp, Artificial Sequence
  Description of Artificial Sequence: Synthetic oligonucleotide
gattttattacgtctaaactgctgtctggtgcggaagacgcgttactgcgt

SEQ ID NO: 3820 - DNA, 51 bp, Artificial Sequence
  Description of Artificial Sequence: Synthetic oligonucleotide
accgatctgcgcttagcgtttaccgccttaattcgtgaggcgttaaataaa

SEQ ID NO: 3821 - DNA, 51 bp, Artificial Sequence
  Description of Artificial Sequence: Synthetic oligonucleotide
ccgaaagtgatcaaccgtctggcgcacgaggtgattgaggcgcaacaggcg

SEQ ID NO: 3822 - DNA, 51 bp, Artificial Sequence
  Description of Artificial Sequence: Synthetic oligonucleotide
tttgaaaccaacgttcgtgaaacccgccgcgtggtggaggcggcccatgcg

SEQ ID NO: 3823 - DNA, 51 bp, Artificial Sequence
  Description of Artificial Sequence: Synthetic oligonucleotide
gaagaactggccatccagaatgcgcgcttagcgatttctattgcccgtaaa

SEQ ID NO: 3824 - DNA, 51 bp, Artificial Sequence
  Description of Artificial Sequence: Synthetic oligonucleotide
gaacagggcaaccgcgaagcgcgtcaagccggccagttactgaaggaagcg

SEQ ID NO: 3825 - DNA, 51 bp, Artificial Sequence
  Description of Artificial Sequence: Synthetic oligonucleotide
ggcaccaaagttacgaaaatggaagatgacatcaaaaaattactgggtcgt

SEQ ID NO: 3826 - DNA, 51 bp, Artificial Sequence
  Description of Artificial Sequence: Synthetic oligonucleotide
cagcgtgcgaagaaggcgattgatttagcctttgaatctgcgaagagcctg

SEQ ID NO: 3827 - DNA, 51 bp, Artificial Sequence
  Description of Artificial Sequence: Synthetic oligonucleotide
aaagaaagccaagttcgtaccgcgaagatcctgaatgttctgaaggaaacc

SEQ ID NO: 3828 - DNA, 51 bp, Artificial Sequence
  Description of Artificial Sequence: Synthetic oligonucleotide
ccgctggaagccgttcgtatgcagaatttaatcgcgcgtgaggcggaggcg

SEQ ID NO: 3829 - DNA, 51 bp, Artificial Sequence
  Description of Artificial Sequence: Synthetic oligonucleotide
gcgcgtgatatcgacacctgggcgaatgttacggcgcgttctattcgcgcg

SEQ ID NO: 3830 - DNA, 51 bp, Artificial Sequence
  Description of Artificial Sequence: Synthetic oligonucleotide
gtggtgaccgacgttcgtgattttttagccgcgcgtgcccaggccctgcgt

SEQ ID NO: 3831 - DNA, 51 bp, Artificial Sequence
  Description of Artificial Sequence: Synthetic oligonucleotide
gcggaaaaagcccaagcgattgcggccgcccgtaatacgtttgcccgtgat

SEQ ID NO: 3832 - DNA, 51 bp, Artificial Sequence
  Description of Artificial Sequence: Synthetic oligonucleotide
ggcgcgacccacgagattcagcgtatgatcggtcgtgcgatgcgcaccgcg

SEQ ID NO: 3833 - DNA, 51 bp, Artificial Sequence
  Description of Artificial Sequence: Synthetic oligonucleotide
accgaagcgtctatcgcgaaagcgaagcgcctgattaagctgtacaatgat

SEQ ID NO: 3834 - DNA, 51 bp, Artificial Sequence
  Description of Artificial Sequence: Synthetic oligonucleotide
gtggaagcggttcgccatatgcgtctgatgaacgaggcgattgcccagctg

SEQ ID NO: 3835 - DNA, 51 bp, Artificial Sequence
  Description of Artificial Sequence: Synthetic oligonucleotide
aaaaccgataacttaaaaattggcaaggactatctggaggatgttattaat

SEQ ID NO: 3836 - DNA, 51 bp, Artificial Sequence
  Description of Artificial Sequence: Synthetic oligonucleotide
gcggtgaccgccaagctggatgaatctttaaccaaagttattgactttatt

SEQ ID NO: 3837 - DNA, 51 bp, Artificial Sequence
  Description of Artificial Sequence: Synthetic oligonucleotide
gatcgtgaaaaggccctggaactggccatggcccagattgacaaaaacttt

SEQ ID NO: 3838 - DNA, 51 bp, Artificial Sequence
  Description of Artificial Sequence: Synthetic oligonucleotide
aatgaactgggtcgcattaataaaatcatcgcggaagttgcggagaaattt

SEQ ID NO: 3839 - DNA, 51 bp, Artificial Sequence
  Description of Artificial Sequence: Synthetic oligonucleotide
gtggatgtgttcaagaccaaagcgcaaccactgattaagcatatcctgacc

SEQ ID NO: 3840 - DNA, 51 bp, Artificial Sequence
  Description of Artificial Sequence: Synthetic oligonucleotide
ctgagcgcggcccaaaccctgcgtgccgcctttattaaggcggagaaagaa

SEQ ID NO: 3841 - DNA, 51 bp, Artificial Sequence
  Description of Artificial Sequence: Synthetic oligonucleotide
ctggatgatttagagaaagcgcgtacggttctggaaaaccgtatcaatgcg

SEQ ID NO: 3842 - DNA, 51 bp, Artificial Sequence
  Description of Artificial Sequence: Synthetic oligonucleotide
gcgggcgaacaagccattcgtcagatcttagatgaagccggcaaggtgggc

SEQ ID NO: 3843 - DNA, 51 bp, Artificial Sequence
  Description of Artificial Sequence: Synthetic oligonucleotide
ggcctgcagcgcgccaaaaccggcacggacaaaaccttagtgaaggaagtg

SEQ ID NO: 3844 - DNA, 51 bp, Artificial Sequence
  Description of Artificial Sequence: Synthetic oligonucleotide
ggcacccagttagagaaactgatggaaaacatgcgcaatgatatcgcgagc

SEQ ID NO: 3845 - DNA, 51 bp, Artificial Sequence
  Description of Artificial Sequence: Synthetic oligonucleotide
gatagcattcgcttactggcgctgttatctctgggcgaggtgggtcatcat

SEQ ID NO: 3846 - DNA, 51 bp, Artificial Sequence
  Description of Artificial Sequence: Synthetic oligonucleotide
attccgagcatctctattatgctgcatgagttaattaaattactgcaccat

SEQ ID NO: 3847 - DNA, 51 bp, Artificial Sequence
  Description of Artificial Sequence: Synthetic oligonucleotide
ctggatgatgttaaggcgctgcattctaagctgacctctgtgttcgcgacc

SEQ ID NO: 3848 - DNA, 51 bp, Artificial Sequence
  Description of Artificial Sequence: Synthetic oligonucleotide
agcaaagaatctggtgtgattcagggtgacctgattgccaaacactggcag

SEQ ID NO: 3849 - DNA, 51 bp, Artificial Sequence
  Description of Artificial Sequence: Synthetic oligonucleotide
acctatgcgcgcgccgaaaaagcgttagttgatattgttcgtcacagccag

SEQ ID NO: 3850 - DNA, 51 bp, Artificial Sequence
  Description of Artificial Sequence: Synthetic oligonucleotide
accaatgaacgcatcgcgcagcgtgccttagaaggcttcacccgcagcctg

SEQ ID NO: 3851 - DNA, 51 bp, Artificial Sequence
  Description of Artificial Sequence: Synthetic oligonucleotide
gcgctgcagaaggagcaggcgaaattatctctggaatcttgggcggacgtg

SEQ ID NO: 3852 - DNA, 51 bp, Artificial Sequence
  Description of Artificial Sequence: Synthetic oligonucleotide
gtggtggatcgcttcctggcggatttacaagatgcggttgcgcaagtgcgt

SEQ ID NO: 3853 - DNA, 51 bp, Artificial Sequence
  Description of Artificial Sequence: Synthetic oligonucleotide
cgtgaagaattaggtcgtcatagctgggccgttctgcatacgctggccgcg

SEQ ID NO: 3854 - DNA, 51 bp, Artificial Sequence
  Description of Artificial Sequence: Synthetic oligonucleotide
ctgccgaccgccaaggatgaactgacgaaggcgctggacctgttaaatagc

SEQ ID NO: 3855 - DNA, 51 bp, Artificial Sequence
  Description of Artificial Sequence: Synthetic oligonucleotide
cgtctggaattaaaggcgctggaagttgccgcgcgtacgagcatcctgacc

SEQ ID NO: 3856 - DNA, 51 bp, Artificial Sequence
  Description of Artificial Sequence: Synthetic oligonucleotide
gcgagcgaacgcggtcagctgatttacaagctggcggacctgatcgaacgt

SEQ ID NO: 3857 - DNA, 51 bp, Artificial Sequence
  Description of Artificial Sequence: Synthetic oligonucleotide
gcgagccatcgcggtcgtctgctgaaccgcctggcggacctgatcgaacgt

SEQ ID NO: 3858 - DNA, 51 bp, Artificial Sequence
  Description of Artificial Sequence: Synthetic oligonucleotide
gatgcgggcgttttagatgcgtatacgcaccataccgagcgtttaaaaagc

SEQ ID NO: 3859 - DNA, 51 bp, Artificial Sequence
  Description of Artificial Sequence: Synthetic oligonucleotide
ggcgaaagccgcgttattagcgtggccgaggtgaaaggtctggttgaacag

SEQ ID NO: 3860 - DNA, 51 bp, Artificial Sequence
  Description of Artificial Sequence: Synthetic oligonucleotide
aaagaagaagccttagaactgattaacggttatattcaaaaaatcaaaagc

SEQ ID NO: 3861 - DNA, 51 bp, Artificial Sequence
  Description of Artificial Sequence: Synthetic oligonucleotide
gataaaggccaaaagattgcgcagcaaatcaaaagcatcattgacattatg

SEQ ID NO: 3862 - DNA, 51 bp, Artificial Sequence
  Description of Artificial Sequence: Synthetic oligonucleotide
tatattgaattagaccgtctgagcacgaacctggcgacgcgtttagcggaa

SEQ ID NO: 3863 - DNA, 51 bp, Artificial Sequence
  Description of Artificial Sequence: Synthetic oligonucleotide
ccggaagtggccgccgaagtgattaaggacctggtgaacaccgttcgtagc

SEQ ID NO: 3864 - DNA, 51 bp, Artificial Sequence
  Description of Artificial Sequence: Synthetic oligonucleotide
tgggaagatacggacgcgctgctgcgccaactggcgaacgcggttaaagcg

SEQ ID NO: 3865 - DNA, 51 bp, Artificial Sequence
  Description of Artificial Sequence: Synthetic oligonucleotide
attgaagcggccacgcatgtgggcaagcaaattgtggagaaaatcctgaaa

SEQ ID NO: 3866 - DNA, 51 bp, Artificial Sequence
  Description of Artificial Sequence: Synthetic oligonucleotide
gatgaaaccatcgagctgctgctgaactctgtgaaagccgcgttcggcaaa

SEQ ID NO: 3867 - DNA, 51 bp, Artificial Sequence
  Description of Artificial Sequence: Synthetic oligonucleotide
caggcggatcgcaaggcggaaaaaatcatctttaatgagctgtctaaagcg

SEQ ID NO: 3868 - DNA, 51 bp, Artificial Sequence
  Description of Artificial Sequence: Synthetic oligonucleotide
accgaagcggccgccgaacagggcgccaagctgctggccaaattccgtcag

SEQ ID NO: 3869 - DNA, 51 bp, Artificial Sequence
  Description of Artificial Sequence: Synthetic oligonucleotide
attaaagaatctatcaaagaactggttgaggaactgtctatgtttgccaaa

SEQ ID NO: 3870 - DNA, 51 bp, Artificial Sequence
  Description of Artificial Sequence: Synthetic oligonucleotide
agccgtctgtctggtgcgctgaatcgcgccgaaggcttaatggaagagctg

SEQ ID NO: 3871 - DNA, 51 bp, Artificial Sequence
  Description of Artificial Sequence: Synthetic oligonucleotide
ctggaaaatttagccgatggctataagcacatgagcctggccctgaaccgt

SEQ ID NO: 3872 - DNA, 51 bp, Artificial Sequence
  Description of Artificial Sequence: Synthetic oligonucleotide
gcgcgtgaaatggccaacgcgaaagaaatcgcccgtaccgttcagatcatg

SEQ ID NO: 3873 - DNA, 51 bp, Artificial Sequence
  Description of Artificial Sequence: Synthetic oligonucleotide
gcggaaaaaatcgaccgttgggtgattttaaacagcattaagctgttagcg

SEQ ID NO: 3874 - DNA, 51 bp, Artificial Sequence
  Description of Artificial Sequence: Synthetic oligonucleotide
gcgcatgtgaagtctcatggcgcgaaggttctggcgtctttttctgaaggc

SEQ ID NO: 3875 - DNA, 51 bp, Artificial Sequence
  Description of Artificial Sequence: Synthetic oligonucleotide
agcgcggcgatccaccgtctggtggacacgagcgaaaagctgtctaaaaaa

SEQ ID NO: 3876 - DNA, 51 bp, Artificial Sequence
  Description of Artificial Sequence: Synthetic oligonucleotide
cgtagcgaacgcgccgaagcgaatttaaagctgctgttaaatgcctttgaa

SEQ ID NO: 3877 - DNA, 51 bp, Artificial Sequence
  Description of Artificial Sequence: Synthetic oligonucleotide
acccgtgaagccgttgcgaaactgacggccgcgcgtttagcggccgatgtg

SEQ ID NO: 3878 - DNA, 51 bp, Artificial Sequence
  Description of Artificial Sequence: Synthetic oligonucleotide
catgaatatcaccaaaccaccattaacaacctgcgtgccgcggccaccgaa

SEQ ID NO: 3879 - DNA, 51 bp, Artificial Sequence
  Description of Artificial Sequence: Synthetic oligonucleotide
gatgtgagcttagagctgctgaccaagggtcgtagcttagcgaacgaactg

SEQ ID NO: 3880 - DNA, 51 bp, Artificial Sequence
  Description of Artificial Sequence: Synthetic oligonucleotide
caggaagaagccttagaactgattaacggttatattcaaaaaatcaaaagc

SEQ ID NO: 3881 - DNA, 51 bp, Artificial Sequence
  Description of Artificial Sequence: Synthetic oligonucleotide
ccggataaaaactacagcaaagcggagaagctgattaaggaagccagcaaa

SEQ ID NO: 3882 - DNA, 51 bp, Artificial Sequence
  Description of Artificial Sequence: Synthetic oligonucleotide
gataatgatcgcgcctttaccattaagaagctggcggagctggttaaagaa

SEQ ID NO: 3883 - DNA, 51 bp, Artificial Sequence
  Description of Artificial Sequence: Synthetic oligonucleotide
ctgaccaaattcggtgaactgctgaacgccagccatgccagcttaaaagat

SEQ ID NO: 3884 - DNA, 51 bp, Artificial Sequence
  Description of Artificial Sequence: Synthetic oligonucleotide
gcgaatgataagaacgcgtttattttaaacaaaattaaggtgatccatggc

SEQ ID NO: 3885 - DNA, 51 bp, Artificial Sequence
  Description of Artificial Sequence: Synthetic oligonucleotide
gtggatgaagccatgtcttttgcggaagttttaaaacaggttaaatctctg

SEQ ID NO: 3886 - DNA, 51 bp, Artificial Sequence
  Description of Artificial Sequence: Synthetic oligonucleotide
ctggtggaaaagaacctgaaaattttcaagggcattgttagcgaggtgatg

SEQ ID NO: 3887 - DNA, 51 bp, Artificial Sequence
  Description of Artificial Sequence: Synthetic oligonucleotide
gtgaaaagcgcccgcattgcgcgtaacacgcagattatcattcaagaagaa

SEQ ID NO: 3888 - DNA, 51 bp, Artificial Sequence
  Description of Artificial Sequence: Synthetic oligonucleotide
attgatgaagccttagcgtttgcggagatcctgaaacaaattaagagcatg

SEQ ID NO: 3889 - DNA, 51 bp, Artificial Sequence
  Description of Artificial Sequence: Synthetic oligonucleotide
cagacccgtatcaaggaactggtgaaggttgcgcaggaggtgggtgcggcg

SEQ ID NO: 3890 - DNA, 51 bp, Artificial Sequence
  Description of Artificial Sequence: Synthetic oligonucleotide
gcgcaggtgaaggacgcgctgaccaagatgcgcgcggcggccctggacgcg

SEQ ID NO: 3891 - DNA, 51 bp, Artificial Sequence
  Description of Artificial Sequence: Synthetic oligonucleotide
gcgaaagcgttaaaggcggtgcaggacaagctgaaagcctttgttgaaagc

SEQ ID NO: 3892 - DNA, 51 bp, Artificial Sequence
  Description of Artificial Sequence: Synthetic oligonucleotide
cgtgatcgtgcccaagcggtggaaacgtacctgaaaaagctgatcgcgacc

SEQ ID NO: 3893 - DNA, 51 bp, Artificial Sequence
  Description of Artificial Sequence: Synthetic oligonucleotide
attccggaattaacgaatctgaaaaacgccctggaagccaaatctaaagaa

SEQ ID NO: 3894 - DNA, 51 bp, Artificial Sequence
  Description of Artificial Sequence: Synthetic oligonucleotide
ccgaaagtgggtcgcgaagcgattacgtctattattgacaccttagaaacc

SEQ ID NO: 3895 - DNA, 51 bp, Artificial Sequence
  Description of Artificial Sequence: Synthetic oligonucleotide
aaagaaagcggtatcattcagggcgacttaattgcgaagcattgggccgcg

SEQ ID NO: 3896 - DNA, 51 bp, Artificial Sequence
  Description of Artificial Sequence: Synthetic oligonucleotide
gtgaccgtgaagcgcaatagcgcgaacgttattgcgcacgaaatcgcgcat

SEQ ID NO: 3897 - DNA, 51 bp, Artificial Sequence
  Description of Artificial Sequence: Synthetic oligonucleotide
cgtaccgaagccgccaatgtggaaaagatcaccaccaagctgttaaaagcg

SEQ ID NO: 3898 - DNA, 51 bp, Artificial Sequence
  Description of Artificial Sequence: Synthetic oligonucleotide
accgcgcgtgttgagaccgtgattggtatcgcggatacgtttttaaaacgt

SEQ ID NO: 3899 - DNA, 51 bp, Artificial Sequence
  Description of Artificial Sequence: Synthetic oligonucleotide
cgtgaagaagccatcagcaatatggtggttgccctgaaagagctgtctatt

SEQ ID NO: 3900 - DNA, 51 bp, Artificial Sequence
  Description of Artificial Sequence: Synthetic oligonucleotide
aaaaaaattgccgaggatgtgaaaacggccggcgcgacgattatcaaaaat

SEQ ID NO: 3901 - DNA, 51 bp, Artificial Sequence
  Description of Artificial Sequence: Synthetic oligonucleotide
attgcggcgcaaaagaatgatgatgaccgccaggcgcgcgcgttagcggcg

SEQ ID NO: 3902 - DNA, 51 bp, Artificial Sequence
  Description of Artificial Sequence: Synthetic oligonucleotide
gaagatgtgcaattaaccctgcgtaacatggccctggaagcctttaaggcg

SEQ ID NO: 3903 - DNA, 51 bp, Artificial Sequence
  Description of Artificial Sequence: Synthetic oligonucleotide
agcgatagccgcatggccatgaccggcgcgatccgcaaagtgttcgtggaa

SEQ ID NO: 3904 - DNA, 51 bp, Artificial Sequence
  Description of Artificial Sequence: Synthetic oligonucleotide
aaagatgcgtctgagatgattaaaaaagccgttgaaatgaccatcagcagc

SEQ ID NO: 3905 - DNA, 51 bp, Artificial Sequence
  Description of Artificial Sequence: Synthetic oligonucleotide
aaaggcccgaaggttcgtacctggctgtctgagaatggcgaggaacgcctg

SEQ ID NO: 3906 - DNA, 51 bp, Artificial Sequence
  Description of Artificial Sequence: Synthetic oligonucleotide
ccggataccttcaaggaactgaaacaaggtgcgcatgccctgaagctggcg

SEQ ID NO: 3907 - DNA, 51 bp, Artificial Sequence
  Description of Artificial Sequence: Synthetic oligonucleotide
ccggaactgttagcccatggccgtcaaaagattctggacctgttaaatgaa

SEQ ID NO: 3908 - DNA, 51 bp, Artificial Sequence
  Description of Artificial Sequence: Synthetic oligonucleotide
ctggaaaccgttcgcaaagcgaccaagtctgcgctggagaaagccgtggaa

SEQ ID NO: 3909 - DNA, 51 bp, Artificial Sequence
  Description of Artificial Sequence: Synthetic oligonucleotide
cagaatattcgcttaaccagcgaaacgcaactgaaaaagctgtctaatgat

SEQ ID NO: 3910 - DNA, 51 bp, Artificial Sequence
  Description of Artificial Sequence: Synthetic oligonucleotide
agcgaaaccgttgaccgtgcgttttctcaaatgaaagcggccattcgcgcg

SEQ ID NO: 3911 - DNA, 51 bp, Artificial Sequence
  Description of Artificial Sequence: Synthetic oligonucleotide
gaaaaaattgttaagatgaataccgatgccgttgatcaggccgtgacgagc

SEQ ID NO: 3912 - DNA, 51 bp, Artificial Sequence
  Description of Artificial Sequence: Synthetic oligonucleotide
gatgcgggccgcgaggcgctggatttagccgcggcgtctattcgcagcggc

SEQ ID NO: 3913 - DNA, 51 bp, Artificial Sequence
  Description of Artificial Sequence: Synthetic oligonucleotide
ccgaaaatgatggcggacggtattgataaaacgttagaagtggccctgacc

SEQ ID NO: 3914 - DNA, 51 bp, Artificial Sequence
  Description of Artificial Sequence: Synthetic oligonucleotide
cgtgcggcgcgcgagctgcaggcggacgccctggaacaactgggttatcag

SEQ ID NO: 3915 - DNA, 51 bp, Artificial Sequence
  Description of Artificial Sequence: Synthetic oligonucleotide
aaaaccgtgaaggacctgaccaaattattatatgaaacggcgttactgacc

SEQ ID NO: 3916 - DNA, 51 bp, Artificial Sequence
  Description of Artificial Sequence: Synthetic oligonucleotide
ggcaccgaagccaacgaagcggcgatcaagattgcgcgcaaatacggcaaa

SEQ ID NO: 3917 - DNA, 51 bp, Artificial Sequence
  Description of Artificial Sequence: Synthetic oligonucleotide
ctgaaagtgcaattaattgataaattaggtgaagtggactttcgcctgacc

SEQ ID NO: 3918 - DNA, 51 bp, Artificial Sequence
  Description of Artificial Sequence: Synthetic oligonucleotide
gaaaaacgtcaaggtgcgctggaattaatcaaaaaaggttatacgcagcag

SEQ ID NO: 3919 - DNA, 51 bp, Artificial Sequence
  Description of Artificial Sequence: Synthetic oligonucleotide
ccggaagcggccgacaaatttaaagagatcaataatgcccatgccattctg

SEQ ID NO: 3920 - DNA, 51 bp, Artificial Sequence
  Description of Artificial Sequence: Synthetic oligonucleotide
aaagaactggccgagaaagcgctgcaagccgtggaaatcgcgcgcgatacc

SEQ ID NO: 3921 - DNA, 51 bp, Artificial Sequence
  Description of Artificial Sequence: Synthetic oligonucleotide
cgtaaacagcacgttgcgggcctgaaggccctgcaggactgggcgcaaaat

SEQ ID NO: 3922 - DNA, 51 bp, Artificial Sequence
  Description of Artificial Sequence: Synthetic oligonucleotide
aaagcggcggttgaccgtgcgctgcaacaagtgacctctaccaaggatgcg

SEQ ID NO: 3923 - DNA, 51 bp, Artificial Sequence
  Description of Artificial Sequence: Synthetic oligonucleotide
aaagcggatgttgacaatgcgctgaacgccgtgacccgcgcgaaggcggcg

SEQ ID NO: 3924 - DNA, 51 bp, Artificial Sequence
  Description of Artificial Sequence: Synthetic oligonucleotide
ctggatatttctttacatgtgctgttagagacctttatcaaaggtctgcgt

SEQ ID NO: 3925 - DNA, 51 bp, Artificial Sequence
  Description of Artificial Sequence: Synthetic oligonucleotide
gaagtgtatggtgagaaaattgtgaaggttcaggaattagcgatcaaaacc

SEQ ID NO: 3926 - DNA, 51 bp, Artificial Sequence
  Description of Artificial Sequence: Synthetic oligonucleotide
cgtgcggaacgcgccggcgaagcgacgcgcagcctgatcgataagattacc

SEQ ID NO: 3927 - DNA, 51 bp, Artificial Sequence
  Description of Artificial Sequence: Synthetic oligonucleotide
aaacatgcggccgagcgtctgcagcaagccctggcgcaagcggccgaacgt

SEQ ID NO: 3928 - DNA, 51 bp, Artificial Sequence
  Description of Artificial Sequence: Synthetic oligonucleotide
gaacagtatacggagaatctgaaagttatcgtggcggagaaattagcgggc

SEQ ID NO: 3929 - DNA, 51 bp, Artificial Sequence
  Description of Artificial Sequence: Synthetic oligonucleotide
cgtgcggaagccgaggcggaagtgcaacgcagcgtggagcgtttcaaagcg

SEQ ID NO: 3930 - DNA, 51 bp, Artificial Sequence
  Description of Artificial Sequence: Synthetic oligonucleotide
aatgcggataagcaagtgaccagcatcttaaaaaaagccggcgacctgctg

SEQ ID NO: 3931 - DNA, 51 bp, Artificial Sequence
  Description of Artificial Sequence: Synthetic oligonucleotide
caggaaacccaaaagggcgcgctgaaggagattcaggcctttatccgtagc

SEQ ID NO: 3932 - DNA, 51 bp, Artificial Sequence
  Description of Artificial Sequence: Synthetic oligonucleotide
gtggaaaccacgcgcaaaattattacgaacctgaccgagggcgccagccgt

SEQ ID NO: 3933 - DNA, 51 bp, Artificial Sequence
  Description of Artificial Sequence: Synthetic oligonucleotide
aaagatggcgagacgaaaattctgaaggagaccgtggaggaattaaaaaaa

SEQ ID NO: 3934 - DNA, 51 bp, Artificial Sequence
  Description of Artificial Sequence: Synthetic oligonucleotide
aaagatgtggagaaggtgattcgtgccgccgcgattgccaataaggaaacc

SEQ ID NO: 3935 - DNA, 51 bp, Artificial Sequence
  Description of Artificial Sequence: Synthetic oligonucleotide
ggctggcgtgccgccgaaaccaatgttgccaaaagcgaggcggagaaacgt

SEQ ID NO: 3936 - DNA, 51 bp, Artificial Sequence
  Description of Artificial Sequence: Synthetic oligonucleotide
cgtctgattgacgcccataatcaggccgttgattttgccgtgcgccaggtg

SEQ ID NO: 3937 - DNA, 51 bp, Artificial Sequence
  Description of Artificial Sequence: Synthetic oligonucleotide
gatgaaacccgccgcgaaatgggcaatgccgccgtgcgtgccgcgaaggcg

SEQ ID NO: 3938 - DNA, 51 bp, Artificial Sequence
  Description of Artificial Sequence: Synthetic oligonucleotide
gtgaatgatttaatcaaagaaaatgttaagatggcggtgaagaatgttgtg

SEQ ID NO: 3939 - DNA, 51 bp, Artificial Sequence
  Description of Artificial Sequence: Synthetic oligonucleotide
gaacaggatttcgccgtgctgaccgccgagattacctctaaaatcgcgcgt

SEQ ID NO: 3940 - DNA, 51 bp, Artificial Sequence
  Description of Artificial Sequence: Synthetic oligonucleotide
aatcaggcggtttctattctggtggccaaggtggaagagattttcaaagat

SEQ ID NO: 3941 - DNA, 51 bp, Artificial Sequence
  Description of Artificial Sequence: Synthetic oligonucleotide
atgggcgcgttaacggcgctgattcgcgaccagaaagcccgtgttgaagcg

SEQ ID NO: 3942 - DNA, 51 bp, Artificial Sequence
  Description of Artificial Sequence: Synthetic oligonucleotide
agccgtgcggacgccgcggtgaccgacgacgcgcgtggtctgttagcggcg

SEQ ID NO: 3943 - DNA, 51 bp, Artificial Sequence
  Description of Artificial Sequence: Synthetic oligonucleotide
ggcgaagaaaagtctcgtgcgctggccgttctgaaagccgcgttaaatagc

SEQ ID NO: 3944 - DNA, 51 bp, Artificial Sequence
  Description of Artificial Sequence: Synthetic oligonucleotide
ctggcggcgcaaaagaccctggtggacggtattcgtaaggaagttgcggcg

SEQ ID NO: 3945 - DNA, 51 bp, Artificial Sequence
  Description of Artificial Sequence: Synthetic oligonucleotide
catgaatttacgaagctggtgaaagagttagaaggcgttattacgaaagcg

SEQ ID NO: 3946 - DNA, 51 bp, Artificial Sequence
  Description of Artificial Sequence: Synthetic oligonucleotide
gtggaagcggccttagataatctgatgatcaaggtgtatgagattacgaaa

SEQ ID NO: 3947 - DNA, 51 bp, Artificial Sequence
  Description of Artificial Sequence: Synthetic oligonucleotide
gatggcaaacgcttagaaaatctggttcgcggcattttcgcgggtaatatt

SEQ ID NO: 3948 - DNA, 51 bp, Artificial Sequence
  Description of Artificial Sequence: Synthetic oligonucleotide
ctgcaggcgacgatcgcgggcaaattagacaaactgcgcgatgcccagcgt

SEQ ID NO: 3949 - DNA, 51 bp, Artificial Sequence
  Description of Artificial Sequence: Synthetic oligonucleotide
aaaaaagatgccgagattagcgcgggtcgcaccgcgttactggccattcag

SEQ ID NO: 3950 - DNA, 51 bp, Artificial Sequence
  Description of Artificial Sequence: Synthetic oligonucleotide
gcggatgtgttaaagaaaaccattaagaacaccctggacattcacaaaagc

SEQ ID NO: 3951 - DNA, 51 bp, Artificial Sequence
  Description of Artificial Sequence: Synthetic oligonucleotide
ctgaatctgaagcaagcgaaagaagaggccattaaagagctggttgatgcg

SEQ ID NO: 3952 - DNA, 51 bp, Artificial Sequence
  Description of Artificial Sequence: Synthetic oligonucleotide
gaaacccatgccaacaaaattgtgcgcgcctatgaattagcgttaaaagtg

SEQ ID NO: 3953 - DNA, 51 bp, Artificial Sequence
  Description of Artificial Sequence: Synthetic oligonucleotide
catgaactgttagacgaaagcgcgaagaagattgtggaggtggccaaaagc

SEQ ID NO: 3954 - DNA, 51 bp, Artificial Sequence
  Description of Artificial Sequence: Synthetic oligonucleotide
catatggcgtctaagcgtgataaaatcgccgatattcaagaagccctggcg

SEQ ID NO: 3955 - DNA, 51 bp, Artificial Sequence
  Description of Artificial Sequence: Synthetic oligonucleotide
gatgatctgcaacgcgcgattgcgttatctctggcggagagcaaccgtgcg

SEQ ID NO: 3956 - DNA, 51 bp, Artificial Sequence
  Description of Artificial Sequence: Synthetic oligonucleotide
gatagcaccgccgccgtggcggtgttaaagcgtgcggttgaattagatgcg

SEQ ID NO: 3957 - DNA, 51 bp, Artificial Sequence
  Description of Artificial Sequence: Synthetic oligonucleotide
gaacagaccgccgaccagatttttaagttaagccatttactgaagctgacc

SEQ ID NO: 3958 - DNA, 51 bp, Artificial Sequence
  Description of Artificial Sequence: Synthetic oligonucleotide
attaccgtggaccgcctggtgagcaaggccctgaatatgtggggtaaagaa

SEQ ID NO: 3959 - DNA, 51 bp, Artificial Sequence
  Description of Artificial Sequence: Synthetic oligonucleotide
agcattgattacgccgcggaaattgccaaggatatgattaagaaagccaat

SEQ ID NO: 3960 - DNA, 51 bp, Artificial Sequence
  Description of Artificial Sequence: Synthetic oligonucleotide
attggcgaacgcgttgtgcgtgcgcacttaagcgtgtgggacgatgttagc

SEQ ID NO: 3961 - DNA, 51 bp, Artificial Sequence
  Description of Artificial Sequence: Synthetic oligonucleotide
ccgagcctggccgagcatgcgctgaaggccctggatcgcattatggcccag

SEQ ID NO: 3962 - DNA, 51 bp, Artificial Sequence
  Description of Artificial Sequence: Synthetic oligonucleotide
aaaggccgtgacatcctgaccaaaacgatcattctggccctgcgcgaagtg

SEQ ID NO: 3963 - DNA, 51 bp, Artificial Sequence
  Description of Artificial Sequence: Synthetic oligonucleotide
gcgcgtgatgttgacaataccattaagttagcgaaagccctgttagaagaa

SEQ ID NO: 3964 - DNA, 51 bp, Artificial Sequence
  Description of Artificial Sequence: Synthetic oligonucleotide
aatgcggcgttagccaaatttgaaacgatccgtgcgcacggcgccctgcgt

SEQ ID NO: 3965 - DNA, 51 bp, Artificial Sequence
  Description of Artificial Sequence: Synthetic oligonucleotide
catattaccgttgaccgtctggtgtctaaggcgctgaacatgtggggcaaa

SEQ ID NO: 3966 - DNA, 51 bp, Artificial Sequence
  Description of Artificial Sequence: Synthetic oligonucleotide
gaagatatggaaaagcgcgcgaatgaagttgccaatctgttaaaaacgctg

SEQ ID NO: 3967 - DNA, 51 bp, Artificial Sequence
  Description of Artificial Sequence: Synthetic oligonucleotide
gatgtgcagatccaaaaagataatttagttaaagatgccattcgcgcgaat

SEQ ID NO: 3968 - DNA, 51 bp, Artificial Sequence
  Description of Artificial Sequence: Synthetic oligonucleotide
aaaggcaccttcgccattgcgaaagccatgggtcgtggcacgcatgagcat

SEQ ID NO: 3969 - DNA, 51 bp, Artificial Sequence
  Description of Artificial Sequence: Synthetic oligonucleotide
cgtgaacgtgttttagaagcggcgcaaggtctgcgtcaagcgttactggcg

SEQ ID NO: 3970 - DNA, 51 bp, Artificial Sequence
  Description of Artificial Sequence: Synthetic oligonucleotide
aaaaaagcggaggccgtggcgaccgttgttgcggcggttgatcaagcgcgt

SEQ ID NO: 3971 - DNA, 51 bp, Artificial Sequence
  Description of Artificial Sequence: Synthetic oligonucleotide
ggcggcggcacggacctgggcaaattcgttctggcgaagaaagaggaaaat

SEQ ID NO: 3972 - DNA, 51 bp, Artificial Sequence
  Description of Artificial Sequence: Synthetic oligonucleotide
aatgatcagttaaagaccgtggtgggtgagtttaccgccctgttagataaa

SEQ ID NO: 3973 - DNA, 51 bp, Artificial Sequence
  Description of Artificial Sequence: Synthetic oligonucleotide
ctggataaaaactacagcaaagcggagaagctgattaaggaagccagcaaa

SEQ ID NO: 3974 - DNA, 51 bp, Artificial Sequence
  Description of Artificial Sequence: Synthetic oligonucleotide
catcatgcggttgagcagattcgtgccaagattagcacggcgatctttcag

SEQ ID NO: 3975 - DNA, 51 bp, Artificial Sequence
  Description of Artificial Sequence: Synthetic oligonucleotide
gatcagcgtcgcttagatctggtgcacacggcggcgttaatgctggacaaa

SEQ ID NO: 3976 - DNA, 51 bp, Artificial Sequence
  Description of Artificial Sequence: Synthetic oligonucleotide
gcgaaagaaaagtctaaatttgaagacatggccaaaagcgacaaagcccgt

SEQ ID NO: 3977 - DNA, 51 bp, Artificial Sequence
  Description of Artificial Sequence: Synthetic oligonucleotide
aaactgggcgagacggaacaggaaggtatcgcgggccgcatgattcgcaat

SEQ ID NO: 3978 - DNA, 51 bp, Artificial Sequence
  Description of Artificial Sequence: Synthetic oligonucleotide
aaagatgaagtttaccagattctggagaagggcgcggccaaacgcaccacc

SEQ ID NO: 3979 - DNA, 51 bp, Artificial Sequence
  Description of Artificial Sequence: Synthetic oligonucleotide
attccgggcatcgttgaagattatcgccaagcggcgcaacgtgccaaacgt

SEQ ID NO: 3980 - DNA, 51 bp, Artificial Sequence
  Description of Artificial Sequence: Synthetic oligonucleotide
ccgaccctggttaacgaaattgcgaaggagattgtgaactatttaaaaaaa

SEQ ID NO: 3981 - DNA, 51 bp, Artificial Sequence
  Description of Artificial Sequence: Synthetic oligonucleotide
cagcgtgcgcgcgccgtgctggatcgcgccgcggaattagcgacgattgcg

SEQ ID NO: 3982 - DNA, 51 bp, Artificial Sequence
  Description of Artificial Sequence: Synthetic oligonucleotide
gcggaagcggagaagcgtattcaggaggccgcggtgacgatttacaaagcg

SEQ ID NO: 3983 - DNA, 51 bp, Artificial Sequence
  Description of Artificial Sequence: Synthetic oligonucleotide
ccgcgtgcgaagaaggtgctggaattatctctgcgtgaggcgttacagctg

SEQ ID NO: 3984 - DNA, 51 bp, Artificial Sequence
  Description of Artificial Sequence: Synthetic oligonucleotide
tttattcagcgcacggcgcatgatcgcatcctgccggccctgatcagcaaa

SEQ ID NO: 3985 - DNA, 51 bp, Artificial Sequence
  Description of Artificial Sequence: Synthetic oligonucleotide
catcgtctgatcgaccaggcgaccgccgagattgtggagaccgccaaacgt

SEQ ID NO: 3986 - DNA, 51 bp, Artificial Sequence
  Description of Artificial Sequence: Synthetic oligonucleotide
tggccgcgtgttcgccgtgatattgccaacctgggccaagcggccgaagcg

SEQ ID NO: 3987 - DNA, 51 bp, Artificial Sequence
  Description of Artificial Sequence: Synthetic oligonucleotide
ccgcgtctgttaggtgaaaccgcgggtttaaaacaggttgaagccgatacc

SEQ ID NO: 3988 - DNA, 51 bp, Artificial Sequence
  Description of Artificial Sequence: Synthetic oligonucleotide
gaaaaaaccttcaacctggcgatggcgttaaaggtggaatctattttaaaa

SEQ ID NO: 3989 - DNA, 51 bp, Artificial Sequence
  Description of Artificial Sequence: Synthetic oligonucleotide
tatggcgtggcccgccagctgaaagagtctcaggataagagcatcgataat

SEQ ID NO: 3990 - DNA, 51 bp, Artificial Sequence
  Description of Artificial Sequence: Synthetic oligonucleotide
gaagcgacccgcgccaaaatgcgtgcggcctctgaacgtttaggctctctg

SEQ ID NO: 3991 - DNA, 51 bp, Artificial Sequence
  Description of Artificial Sequence: Synthetic oligonucleotide
accgcgcataagaacgcggtgaccttacgcgtgaatgccctgaaggaacag

SEQ ID NO: 3992 - DNA, 51 bp, Artificial Sequence
  Description of Artificial Sequence: Synthetic oligonucleotide
cagctggcggttgagaaaggcaatttagagaataaaaagagcatcaccgaa

SEQ ID NO: 3993 - DNA, 51 bp, Artificial Sequence
  Description of Artificial Sequence: Synthetic oligonucleotide
tatccgctgttagttaaaattctggactctctgggcgagcgtaaggtgacc

SEQ ID NO: 3994 - DNA, 51 bp, Artificial Sequence; identical to SEQ ID NO: 1326
  Description of Artificial Sequence: Synthetic oligonucleotide

SEQ ID NO: 3995 - DNA, 51 bp, Artificial Sequence
  Description of Artificial Sequence: Synthetic oligonucleotide
accgcggcgaagaacgcggcgctggaggccgtggcgcgcgcgatcgaacgt

SEQ ID NO: 3996 - DNA, 51 bp, Artificial Sequence
  Description of Artificial Sequence: Synthetic oligonucleotide
ccggaaaccttacgccaggtgacccaacacgcggaacacgtggttaatgcg

SEQ ID NO: 3997 - DNA, 51 bp, Artificial Sequence
  Description of Artificial Sequence: Synthetic oligonucleotide
ggcgcgcatcgcgccacctatctgcgcgccattgcggccaaaatcaccgaa

SEQ ID NO: 3998 - DNA, 51 bp, Artificial Sequence; identical to SEQ ID NO: 1183
  Description of Artificial Sequence: Synthetic oligonucleotide

SEQ ID NO: 3999 - DNA, 51 bp, Artificial Sequence
  Description of Artificial Sequence: Synthetic oligonucleotide
gcggaagcggccaaggcggaaattgttgccagctttgagcgtgccaaaaat

SEQ ID NO: 4000 - DNA, 51 bp, Artificial Sequence
  Description of Artificial Sequence: Synthetic oligonucleotide
accgaagtggacatccaggcgagcatggcctacgcgaaagccctggagaaa

SEQ ID NO: 4001 - DNA, 51 bp, Artificial Sequence
  Description of Artificial Sequence: Synthetic oligonucleotide
catagcagcaagaacgatattcatacgttactgatggatttaaattcttat

SEQ ID NO: 4002 - DNA, 51 bp, Artificial Sequence
  Description of Artificial Sequence: Synthetic oligonucleotide
attagcagcatcacggatggcctgaagacgaaaattgttgcggagcgtctg

SEQ ID NO: 4003 - DNA, 51 bp, Artificial Sequence
  Description of Artificial Sequence: Synthetic oligonucleotide
agcgatattcgcgacattgtgcagtctgcccatatgcgtgttgtgaaggaa

SEQ ID NO: 4004 - DNA, 51 bp, Artificial Sequence
  Description of Artificial Sequence: Synthetic oligonucleotide
tttcgtcaggcccacaccgcgagcggtaaggcggtgcacctggccgaaacc

SEQ ID NO: 4005 - DNA, 51 bp, Artificial Sequence
  Description of Artificial Sequence: Synthetic oligonucleotide
catagcagcaagaacgatattcatacgttactgaaagacctgaacagctat

SEQ ID NO: 4006 - DNA, 51 bp, Artificial Sequence
  Description of Artificial Sequence: Synthetic oligonucleotide
ctggcggtggagttaaaacagagcacggcccaggcgcacgaaaaggcggaa

SEQ ID NO: 4007 - DNA, 51 bp, Artificial Sequence
  Description of Artificial Sequence: Synthetic oligonucleotide
gaactggaagccgaggcgacccatcgcgttattaccatcgcgaaccgtacc

SEQ ID NO: 4008 - DNA, 51 bp, Artificial Sequence
  Description of Artificial Sequence: Synthetic oligonucleotide
agcgaagtggacatccaggcgagcatcgcctatgcgaaggcgttagaaaaa

SEQ ID NO: 4009 - DNA, 51 bp, Artificial Sequence
  Description of Artificial Sequence: Synthetic oligonucleotide
aaaattctggaggccagcgtgattatctggcgcgtgattgacgatacggcg

SEQ ID NO: 4010 - DNA, 51 bp, Artificial Sequence
  Description of Artificial Sequence: Synthetic oligonucleotide
cgtggccagcgccaaatggaagtgctgtctgccattattgacaaatctaaa

SEQ ID NO: 4011 - DNA, 51 bp, Artificial Sequence
  Description of Artificial Sequence: Synthetic oligonucleotide
catgaaaaattaacgcaggcgcgtaaccaactgctggccgaagccgcgaaa

SEQ ID NO: 4012 - DNA, 51 bp, Artificial Sequence
  Description of Artificial Sequence: Synthetic oligonucleotide
ccggaagtgcaccgcctgacccatgccttacgtgcggccacccgcattgtg

SEQ ID NO: 4013 - DNA, 51 bp, Artificial Sequence
  Description of Artificial Sequence: Synthetic oligonucleotide
aaagatgcgcgcgccctgcaggcggacgccatggaacagttaggctaccag

SEQ ID NO: 4014 - DNA, 51 bp, Artificial Sequence
  Description of Artificial Sequence: Synthetic oligonucleotide
cagcgtcatgttgagcgtgcggcgcgcgccgcggtgcaagcgttacagctg

SEQ ID NO: 4015 - DNA, 51 bp, Artificial Sequence
  Description of Artificial Sequence: Synthetic oligonucleotide
gtggaagatacggttgaagcgctgggtaagattcgtaacgcgatcgcgcgt

SEQ ID NO: 4016 - DNA, 51 bp, Artificial Sequence
  Description of Artificial Sequence: Synthetic oligonucleotide
aatgaagcggccgacctggtgattaagtctatggaaaaaacgattgccagc

SEQ ID NO: 4017 - DNA, 51 bp, Artificial Sequence
  Description of Artificial Sequence: Synthetic oligonucleotide
gcgaccgatcaaaaggtggaaaaaatgttaatcagcagcatcaaagagaaa

SEQ ID NO: 4018 - DNA, 51 bp, Artificial Sequence
  Description of Artificial Sequence: Synthetic oligonucleotide
gcggatgatacgttagcgctggcgcgcgcccgtggcgaggcgatgtctgcg

SEQ ID NO: 4019 - DNA, 51 bp, Artificial Sequence
  Description of Artificial Sequence: Synthetic oligonucleotide
cgtgaagtgtctttaaccagcggccgcttagtgctgcaaggcttacgtgat

SEQ ID NO: 4020 - DNA, 51 bp, Artificial Sequence
  Description of Artificial Sequence: Synthetic oligonucleotide
ccggatgtgcgcgagatgaatggcgtgttaaagggcatgctgtctgaatgg

SEQ ID NO: 4021 - DNA, 51 bp, Artificial Sequence
  Description of Artificial Sequence: Synthetic oligonucleotide
gtggaagaagccgttcgtattgtgaaggaggtgattcaaaaattagcgaat

SEQ ID NO: 4022 - DNA, 51 bp, Artificial Sequence
  Description of Artificial Sequence: Synthetic oligonucleotide
ctgattaaacaagccgaagcgaaaaaggagctggaagtttttttagatacc

SEQ ID NO: 4023 - DNA, 51 bp, Artificial Sequence
  Description of Artificial Sequence: Synthetic oligonucleotide
gtgaatctgatccgcgaacgtggccaattcattggcgaggaagttaaagcg

SEQ ID NO: 4024 - DNA, 51 bp, Artificial Sequence
  Description of Artificial Sequence: Synthetic oligonucleotide
ctggatgaatctttaaaaattgtgaaggagtatctgatcgcggccaccgcg

SEQ ID NO: 4025 - DNA, 51 bp, Artificial Sequence
  Description of Artificial Sequence: Synthetic oligonucleotide
gcgaaagtgttagcccatggcgaaaaggttctgacctcttttggtgaaggc

SEQ ID NO: 4026 - DNA, 51 bp, Artificial Sequence
  Description of Artificial Sequence: Synthetic oligonucleotide
cgttatgaacgccaaaaaattctgttagccaccgcggaggcgttagcggcg

SEQ ID NO: 4027 - DNA, 51 bp, Artificial Sequence
  Description of Artificial Sequence: Synthetic oligonucleotide
ccgaccatttctttaaaaaccgtgaagttaatgaaagaaggtctggaggcg

SEQ ID NO: 4028 - DNA, 51 bp, Artificial Sequence
  Description of Artificial Sequence: Synthetic oligonucleotide
accaaagaaaagatcgcgattaccgagaacgcgctggccgtggcccatcag

SEQ ID NO: 4029 - DNA, 51 bp, Artificial Sequence
  Description of Artificial Sequence: Synthetic oligonucleotide
ggcgtgccggcctctaaaaccattgccgagcgtgatttaaaagccatggat

SEQ ID NO: 4030 - DNA, 51 bp, Artificial Sequence
  Description of Artificial Sequence: Synthetic oligonucleotide
acctatctgaagcacgatagcgtgttaaagaccattcgcggcttagtggaa

SEQ ID NO: 4031 - DNA, 51 bp, Artificial Sequence
  Description of Artificial Sequence: Synthetic oligonucleotide
gcggaagtggccgagaccaaagtggccatggttaataaatacgcgcgcgaa

SEQ ID NO: 4032 - DNA, 51 bp, Artificial Sequence
  Description of Artificial Sequence: Synthetic oligonucleotide
gatgcgctggttcgcgatgcgcagcaagccgcggcgcgcattgccgatagc

SEQ ID NO: 4033 - DNA, 51 bp, Artificial Sequence
  Description of Artificial Sequence: Synthetic oligonucleotide
gataccatggcggactcttatggcaaagttatgggtcgtgatggtcgtgcg

SEQ ID NO: 4034 - DNA, 51 bp, Artificial Sequence
  Description of Artificial Sequence: Synthetic oligonucleotide
ccgggcctggttaaggaaaccaaacgcgccctgaatcgcgcgttagaaacc

SEQ ID NO: 4035 - DNA, 51 bp, Artificial Sequence
  Description of Artificial Sequence: Synthetic oligonucleotide
tatctgaaagaggccctgcgtctggcccaagaagcgttaaatcgcctgggc

SEQ ID NO: 4036 - DNA, 51 bp, Artificial Sequence
  Description of Artificial Sequence: Synthetic oligonucleotide
catagcgtgtggcaacgcatgggcgatgaattattagcgaaagccgcggaa

SEQ ID NO: 4037 - DNA, 51 bp, Artificial Sequence
  Description of Artificial Sequence: Synthetic oligonucleotide
gcggatgaaatcaagaatgtgtggaaagaggaggtgagccgcctggttggc

SEQ ID NO: 4038 - DNA, 51 bp, Artificial Sequence
  Description of Artificial Sequence: Synthetic oligonucleotide
gaagcggcggttacgcgtagcgcggagcgcattgtgggtcagatggagaaa

SEQ ID NO: 4039 - DNA, 51 bp, Artificial Sequence
  Description of Artificial Sequence: Synthetic oligonucleotide
gaagcgcagcgcacggcgctgtatacgaaggcggaacaacagttagataaa

SEQ ID NO: 4040 - DNA, 51 bp, Artificial Sequence
  Description of Artificial Sequence: Synthetic oligonucleotide
ctggaagatcgcgccgcgaccctgtctaagattattcaagtggccgtggaa

SEQ ID NO: 4041 - DNA, 51 bp, Artificial Sequence
  Description of Artificial Sequence: Synthetic oligonucleotide
gaaaccggcatcaaggaagcgaaattaggtggcgaacgcctgaagagccgt

SEQ ID NO: 4042 - DNA, 51 bp, Artificial Sequence
  Description of Artificial Sequence: Synthetic oligonucleotide
cagcagcagttagaccgtgcgattgaggcctttggccaagtgggtaaaaaa

SEQ ID NO: 4043 - DNA, 51 bp, Artificial Sequence
  Description of Artificial Sequence: Synthetic oligonucleotide
ccggcggcggccgacgcgaccattgccgaggcggtgaagagcgcccgtaaa

SEQ ID NO: 4044 - DNA, 51 bp, Artificial Sequence
  Description of Artificial Sequence: Synthetic oligonucleotide
gaagaaaatttaaagcaggcgcgtgccgccctggaacgcctgtacaccgcg

SEQ ID NO: 4045 - DNA, 51 bp, Artificial Sequence
  Description of Artificial Sequence: Synthetic oligonucleotide
ccggaagtgacggttgaagcgattaagcgcctgagcgacctgttcgcgcgt

SEQ ID NO: 4046 - DNA, 51 bp, Artificial Sequence
  Description of Artificial Sequence: Synthetic oligonucleotide
agccatgatgcccgcaaagaacataagcaatttgtggccgaattaaaagcg

SEQ ID NO: 4047 - DNA, 51 bp, Artificial Sequence
  Description of Artificial Sequence: Synthetic oligonucleotide
gcggcgcagcgcgcccgtgtggaaacggaggcgctgaagtatttacgtgcg

SEQ ID NO: 4048 - DNA, 51 bp, Artificial Sequence
  Description of Artificial Sequence: Synthetic oligonucleotide
ccgctgaccgttaagaaacatctgcgcgcccaggcgatcgcgttagaaaat

SEQ ID NO: 4049 - DNA, 51 bp, Artificial Sequence
  Description of Artificial Sequence: Synthetic oligonucleotide
accgatgcggttaagaaaattgcggaggccgcgtttcgcgtgaacgaaaaa

SEQ ID NO: 4050 - DNA, 51 bp, Artificial Sequence
  Description of Artificial Sequence: Synthetic oligonucleotide
ctggaaaattctaagctgaatcagaaggttattgatgccatttaccgtgcg

SEQ ID NO: 4051 - DNA, 51 bp, Artificial Sequence
  Description of Artificial Sequence: Synthetic oligonucleotide
ctgaccgaattaaacagcctgatttctcgcctggcggacgatacgaaaacc

SEQ ID NO: 4052 - DNA, 51 bp, Artificial Sequence
  Description of Artificial Sequence: Synthetic oligonucleotide
attaatgatggtttacgtattgcgcgcaagctgctgttagatatcaatgat

SEQ ID NO: 4053 - DNA, 51 bp, Artificial Sequence
  Description of Artificial Sequence: Synthetic oligonucleotide
aatgaagcgtctaaggcgctgacctctgcccgttttgttctgtctgataaa

SEQ ID NO: 4054 - DNA, 51 bp, Artificial Sequence
  Description of Artificial Sequence: Synthetic oligonucleotide
gcggtgagcgagcgcggcgcggcggaggccctgaccgccattcgccgtggc

SEQ ID NO: 4055 - DNA, 51 bp, Artificial Sequence
  Description of Artificial Sequence: Synthetic oligonucleotide
cgtaccggcgttttcattgcgctggaccacctgacccaacatatcaatgat

SEQ ID NO: 4056 - DNA, 51 bp, Artificial Sequence
  Description of Artificial Sequence: Synthetic oligonucleotide
ctgcatgaaaagttatttctgctggccatcgtgcgttctctgaagattagc

SEQ ID NO: 4057 - DNA, 51 bp, Artificial Sequence
  Description of Artificial Sequence: Synthetic oligonucleotide
aaagatacctctaagaaagtgcagatggcccgcctggcgtgggaggcgagc

SEQ ID NO: 4058 - DNA, 51 bp, Artificial Sequence
  Description of Artificial Sequence: Synthetic oligonucleotide
ggcctgcagaaggagcaggcgaaattatctctggaatcttgggcggacgtg

SEQ ID NO: 4059 - DNA, 51 bp, Artificial Sequence
  Description of Artificial Sequence: Synthetic oligonucleotide
ctgaccaaaaacttaaaagtggtgaaggagctgatttctgaagccattcag

SEQ ID NO: 4060 - DNA, 51 bp, Artificial Sequence
  Description of Artificial Sequence: Synthetic oligonucleotide
gatgcgaccacggccgcgcgtgcggcccgcctggcggccgtggccgaagat

SEQ ID NO: 4061 - DNA, 51 bp, Artificial Sequence
  Description of Artificial Sequence: Synthetic oligonucleotide
gaagcgcatgccgagaaagtgcattcttacgtgaccgccggcatcaccagc

SEQ ID NO: 4062 - DNA, 54 bp, Artificial Sequence
  Description of Artificial Sequence: Synthetic oligonucleotide
cagctggtggcccgcctggaaggcgaggttatgctgagcgccctggcccgtaaa

SEQ ID NO: 4063 - DNA, 54 bp, Artificial Sequence
  Description of Artificial Sequence: Synthetic oligonucleotide
accgcgcgtgttgaggaagcgcagcaagccgcggtgcgcattgccgataccctg

SEQ ID NO: 4064 - DNA, 54 bp, Artificial Sequence
  Description of Artificial Sequence: Synthetic oligonucleotide
ccgcgtagcgttggtaaagcgagcgagcaactggcgggtaaagttgcggaagtg

SEQ ID NO: 4065 - DNA, 54 bp, Artificial Sequence
  Description of Artificial Sequence: Synthetic oligonucleotide
gaagcggatatccacgaaggcatgcagcgcttcgcgcaggccgtgggtaaagtg

SEQ ID NO: 4066 - DNA, 54 bp, Artificial Sequence
  Description of Artificial Sequence: Synthetic oligonucleotide
ccgaaactggttcgcgcggcggtggaggcccatagcaaggcgttagatagcgcg

SEQ ID NO: 4067 - DNA, 54 bp, Artificial Sequence
  Description of Artificial Sequence: Synthetic oligonucleotide
ctggaaaccgttcgcaaagcgaccaagtctgcgctggagaaagccgtggaactg

SEQ ID NO: 4068 - DNA, 54 bp, Artificial Sequence
  Description of Artificial Sequence: Synthetic oligonucleotide
agcctggaaacggttcgtaaagcgacgaagagcgcgttagaaaaggcggtggaa

SEQ ID NO: 4069 - DNA, 54 bp, Artificial Sequence
  Description of Artificial Sequence: Synthetic oligonucleotide
gaacgttttaacgccgcgctgcatgagtctgcgcatacggtgatcgcgcaggtg

SEQ ID NO: 4070 - DNA, 54 bp, Artificial Sequence
  Description of Artificial Sequence: Synthetic oligonucleotide
agcgaagtggacatccagggcagcatggcctacgcgaaagccctggagaaagcg

SEQ ID NO: 4071 - DNA, 54 bp, Artificial Sequence
  Description of Artificial Sequence: Synthetic oligonucleotide
cgtgcggcggccgccgaaattgcggttaagaccgtgtctgaattcattacccgt

SEQ ID NO: 4072 - DNA, 54 bp, Artificial Sequence
  Description of Artificial Sequence: Synthetic oligonucleotide
attgcggcgggtcaaaatgaactgttaaagcgtgcgaaggcgaacggcgatgcg

SEQ ID NO: 4073 - DNA, 54 bp, Artificial Sequence
  Description of Artificial Sequence: Synthetic oligonucleotide
gatgcgggccgcaagaattttgcgaagacggcggtgaagctgttacaggatctg

SEQ ID NO: 4074 - DNA, 54 bp, Artificial Sequence
  Description of Artificial Sequence: Synthetic oligonucleotide
gaaatggcgttcaagattgcgggctctatggccattaaagaggcggttcagaaa

SEQ ID NO: 4075 - DNA, 54 bp, Artificial Sequence
  Description of Artificial Sequence: Synthetic oligonucleotide
gcgcgtgaattagccgaactgggcatgaagatcaccgcggccgcgaacgaacag

SEQ ID NO: 4076 - DNA, 54 bp, Artificial Sequence
  Description of Artificial Sequence: Synthetic oligonucleotide
gaaaaaaccatgttagttctggcgctgttattagcgaaaaaggtggccagccat

SEQ ID NO: 4077 - DNA, 54 bp, Artificial Sequence
  Description of Artificial Sequence: Synthetic oligonucleotide
gcggatgcgcaaaagcgtgaagtggccgcctttctggcccagacgagccatgaa

SEQ ID NO: 4078 - DNA, 54 bp, Artificial Sequence
  Description of Artificial Sequence: Synthetic oligonucleotide
attgcgcataacttagcgcaggtgcgcgacaaaatttctgcggccgcgacccgt

SEQ ID NO: 4079 - DNA, 54 bp, Artificial Sequence
  Description of Artificial Sequence: Synthetic oligonucleotide
ggcgatccgatcgagattaatggcttaaaggcggcgttcaaagagctgagcaat

SEQ ID NO: 4080 - DNA, 54 bp, Artificial Sequence
  Description of Artificial Sequence: Synthetic oligonucleotide
ctgccgggccgcatcgtgcaggatcaaaagaatgcgcgcgcgcacgcggtgacc

SEQ ID NO: 4081 - DNA, 54 bp, Artificial Sequence
  Description of Artificial Sequence: Synthetic oligonucleotide
gaatttgatttattaggccaggcggccgccagcaaattagcgcgcgatctgacc

SEQ ID NO: 4082 - DNA, 54 bp, Artificial Sequence
  Description of Artificial Sequence: Synthetic oligonucleotide
accgatgaaggtttaaaagaagcgacgaagctgacccaaagcgttaaaaaactg

SEQ ID NO: 4083 - DNA, 54 bp, Artificial Sequence
  Description of Artificial Sequence: Synthetic oligonucleotide
gatgcggaattagcccagagcatttctatgacgcgtgcggaggcgaaggcggcg

SEQ ID NO: 4084 - DNA, 54 bp, Artificial Sequence
  Description of Artificial Sequence: Synthetic oligonucleotide
ggcagcgcgttcgagagcgcgatggtgaaccacgtgaccaaggtggccgatcat

SEQ ID NO: 4085 - DNA, 54 bp, Artificial Sequence
  Description of Artificial Sequence: Synthetic oligonucleotide
gcgaaagtgaaggcccatggcaaaaaggttattgattctttttctgaaggcctg

SEQ ID NO: 4086 - DNA, 54 bp, Artificial Sequence
  Description of Artificial Sequence: Synthetic oligonucleotide
agcaaagaatctggtattattcagggtgacctgattgccaaacactgggcggcg

SEQ ID NO: 4087 - DNA, 54 bp, Artificial Sequence
  Description of Artificial Sequence: Synthetic oligonucleotide
gcggaacaggcccaacaggtgcatgccttcctgcgtggtcgtttagcggcgaaa

SEQ ID NO: 4088 - DNA, 54 bp, Artificial Sequence
  Description of Artificial Sequence: Synthetic oligonucleotide
gcggatctgaagggtcagctggcgcaacgcattgtggacgatgttagcgtggcg

SEQ ID NO: 4089 - DNA, 54 bp, Artificial Sequence
  Description of Artificial Sequence: Synthetic oligonucleotide
agcgaaagcttagttaaaaccctgatctctgaatttgccgcggttgcggaaaaa

SEQ ID NO: 4090 - DNA, 54 bp, Artificial Sequence
  Description of Artificial Sequence: Synthetic oligonucleotide
tttcgtcaggcccacaccgcgagcggtaaggcggtgcacctggccgaaaccaaa

SEQ ID NO: 4091 - DNA, 54 bp, Artificial Sequence
  Description of Artificial Sequence: Synthetic oligonucleotide
attcagagcaaggttgcgctgaaaacgttcgcggcggccgatcaacgtgaagcg

SEQ ID NO: 4092 - DNA, 54 bp, Artificial Sequence
  Description of Artificial Sequence: Synthetic oligonucleotide
gataatgtgatgacggccgaaatgcgtaaaatcgccatggcggcggttctggat

SEQ ID NO: 4093 - DNA, 54 bp, Artificial Sequence
  Description of Artificial Sequence: Synthetic oligonucleotide
attagctatatcatccgtaaagcggactctgtgaataaggcgttagatagcgcg

SEQ ID NO: 4094 - DNA, 54 bp, Artificial Sequence
  Description of Artificial Sequence: Synthetic oligonucleotide
gtgagcaaaatgttagccagctttgaaaagatcattaccgagaccgttgcgaaa

SEQ ID NO: 4095 - DNA, 54 bp, Artificial Sequence
  Description of Artificial Sequence: Synthetic oligonucleotide
gcggcggaagttaacacccgtgtggccaaggtggtgcaagatgccgcgaataaa

SEQ ID NO: 4096 - DNA, 54 bp, Artificial Sequence
  Description of Artificial Sequence: Synthetic oligonucleotide
aataaagaacaagccaaagcgcgtgaggccattggcaacggcttaaccatgctg

SEQ ID NO: 4097 - DNA, 54 bp, Artificial Sequence
  Description of Artificial Sequence: Synthetic oligonucleotide
ccgatgattgccaagcatggcaccacgatcctgcatggtctggaccgtgcggtg

SEQ ID NO: 4098 - DNA, 54 bp, Artificial Sequence
  Description of Artificial Sequence: Synthetic oligonucleotide
gaaaaaattttaaacgatgtgagccaagccaaagcgcaacatttaaaagcggcg

SEQ ID NO: 4099 - DNA, 54 bp, Artificial Sequence
  Description of Artificial Sequence: Synthetic oligonucleotide
gtggtggcggaggttaaagcgtttttagaggcgcaggcccgtcgcgcgctgagc

SEQ ID NO: 4100 - DNA, 54 bp, Artificial Sequence
  Description of Artificial Sequence: Synthetic oligonucleotide
ccgattgcgatcgccgaagtgcgtgaggccctgacccgcaccttagcgaccgaa

SEQ ID NO: 4101 - DNA, 54 bp, Artificial Sequence
  Description of Artificial Sequence: Synthetic oligonucleotide
gcgggcgcggccacggaagaatttatcaagcgtgcggaggtgaacggcctggcg

SEQ ID NO: 4102 - DNA, 54 bp, Artificial Sequence
  Description of Artificial Sequence: Synthetic oligonucleotide
gcgaaagatgccggtctgtttattggttctattgtgcaagaaatcgcggaacgt

SEQ ID NO: 4103 - DNA, 54 bp, Artificial Sequence
  Description of Artificial Sequence: Synthetic oligonucleotide
tatgatattgccatggagattgtgaatggtgttgatcgtgttattaaggcgagc

SEQ ID NO: 4104 - DNA, 54 bp, Artificial Sequence
  Description of Artificial Sequence: Synthetic oligonucleotide
gatgcggcgacgatcaaagcgctgttatctcatgcgcacgaagcccagcgtagc

SEQ ID NO: 4105 - DNA, 54 bp, Artificial Sequence
  Description of Artificial Sequence: Synthetic oligonucleotide
aaaaatgaacaattagcgattgcgcacggtattcagaagattatcgcggaaaat

SEQ ID NO: 4106 - DNA, 54 bp, Artificial Sequence
  Description of Artificial Sequence: Synthetic oligonucleotide
ctggcggcgcaaaagaccctggtggacggtattcgtaaggaagttgcggcggaa

SEQ ID NO: 4107 - DNA, 54 bp, Artificial Sequence
  Description of Artificial Sequence: Synthetic oligonucleotide
aaagcggcgttcttaaaagcgaccgacgagctgattgccgcggttaccgcgcat

SEQ ID NO: 4108 - DNA, 54 bp, Artificial Sequence
  Description of Artificial Sequence: Synthetic oligonucleotide
gcggaagcgcgcggtaatcgtatggcggaccaagcggcgcgcgaagccgcgatg

SEQ ID NO: 4109 - DNA, 54 bp, Artificial Sequence
  Description of Artificial Sequence: Synthetic oligonucleotide
ggcgcgcaggccttaaaagcggtgttagagcatggcccaaccttacgtcagcgt

SEQ ID NO: 4110 - DNA, 54 bp, Artificial Sequence
  Description of Artificial Sequence: Synthetic oligonucleotide
aaagtgggcaacatcattgataccatgatcacggatgcgttcctgaaggcggat

SEQ ID NO: 4111 - DNA, 54 bp, Artificial Sequence
  Description of Artificial Sequence: Synthetic oligonucleotide
ggcggcgcgaaggccagcgatgatgcccgcaccctggccgaagtttttaccaaa

SEQ ID NO: 4112 - DNA, 54 bp, Artificial Sequence
  Description of Artificial Sequence: Synthetic oligonucleotide
cgtgcgaaagcctcttttgatacccgcgttgcggcggccgaattagcgctggcg

SEQ ID NO: 4113 - DNA, 54 bp, Artificial Sequence
  Description of Artificial Sequence: Synthetic oligonucleotide
accgatcagttattagaacatgcgaaggagagcctgacgcatgccaaagcggcg

SEQ ID NO: 4114 - DNA, 54 bp, Artificial Sequence
  Description of Artificial Sequence: Synthetic oligonucleotide
cgtgcggaagttgacctggtggtgcaagacctgaaacaagcggttgcgcagctg

SEQ ID NO: 4115 - DNA, 54 bp, Artificial Sequence
  Description of Artificial Sequence: Synthetic oligonucleotide
ggcgcggatttagagaatctgctgaacgaggcggcgttactggccgcgcgtaaa

SEQ ID NO: 4116 - DNA, 54 bp, Artificial Sequence
  Description of Artificial Sequence: Synthetic oligonucleotide
gcggatgtgcgcaagaatgcgaatgaggccgtgctgggtattatgatccatctg

SEQ ID NO: 4117 - DNA, 54 bp, Artificial Sequence
  Description of Artificial Sequence: Synthetic oligonucleotide
attgcggcggccatcgaaaccacccgcacggtgctggccgcggcccgtgaacgt

SEQ ID NO: 4118 - DNA, 54 bp, Artificial Sequence
  Description of Artificial Sequence: Synthetic oligonucleotide
gtggaagcggacgttaccattggcccatacctgaaagcccaggccgataaacag

SEQ ID NO: 4119 - DNA, 54 bp, Artificial Sequence
  Description of Artificial Sequence: Synthetic oligonucleotide
accaaacagatcttagatgcgaaaggtccagaaggcgttgtggactgggtgaaa

SEQ ID NO: 4120 - DNA, 54 bp, Artificial Sequence
  Description of Artificial Sequence: Synthetic oligonucleotide
ggcgcgcaggccttaaaagcggtgttagagcatggcccaaccttaaatgaacgt

SEQ ID NO: 4121 - DNA, 54 bp, Artificial Sequence
  Description of Artificial Sequence: Synthetic oligonucleotide
cgtccggaagccgaggcggtgagcatgttagttaaagaagccgtggttaccttt

SEQ ID NO: 4122 - DNA, 54 bp, Artificial Sequence
  Description of Artificial Sequence: Synthetic oligonucleotide
attgcggataaggccgaacaggtgatccaaaatattaagaatgttctggaagcg

SEQ ID NO: 4123 - DNA, 54 bp, Artificial Sequence
  Description of Artificial Sequence: Synthetic oligonucleotide
ccgatggtgcgcgcccatggcaaaaaggttctgacctcttttggtgatgcggtg

SEQ ID NO: 4124 - DNA, 54 bp, Artificial Sequence
  Description of Artificial Sequence: Synthetic oligonucleotide
agcaataaagaggccctggcgaaaggtatgttactgctgttcgcgcaccatctg

SEQ ID NO: 4125 - DNA, 54 bp, Artificial Sequence
  Description of Artificial Sequence: Synthetic oligonucleotide
ccgctggaagccgttcgtatgcagaatttaatcgcgcgtgaggcggaggcggcg

SEQ ID NO: 4126 - DNA, 54 bp, Artificial Sequence
  Description of Artificial Sequence: Synthetic oligonucleotide
gcgaccggcgacttagcgctgaaaaagttagaaaatgccattaagaaagtgcag

SEQ ID NO: 4127 - DNA, 54 bp, Artificial Sequence
  Description of Artificial Sequence: Synthetic oligonucleotide
gtggaaacccgcaaggtgatggcggatttagttgtgggcaacctggaggcgcat

SEQ ID NO: 4128 - DNA, 54 bp, Artificial Sequence
  Description of Artificial Sequence: Synthetic oligonucleotide
gcgcagacccgcgacggcattattgccggttttaaaaaggcgttagatgaaacc

SEQ ID NO: 4129 - DNA, 54 bp, Artificial Sequence
  Description of Artificial Sequence: Synthetic oligonucleotide
aaagatctggcctctgcgctggaattattaaccggcttacgtaagaaaattgcg

SEQ ID NO: 4130 - DNA, 54 bp, Artificial Sequence
  Description of Artificial Sequence: Synthetic oligonucleotide
cgtgcgcaggcccaaaaactggcgggtacggcgcatgacggcttagcgcgtgcg

SEQ ID NO: 4131 - DNA, 54 bp, Artificial Sequence
  Description of Artificial Sequence: Synthetic oligonucleotide
ccgaccctggttaagcgtcaggcgacgacgattgcgaaggaattagcggaactg

SEQ ID NO: 4132 - DNA, 54 bp, Artificial Sequence
  Description of Artificial Sequence: Synthetic oligonucleotide
gtggaaaaaaacttaaaaatttttaagggtattgtgtctgaagttatggcgagc

SEQ ID NO: 4133 - DNA, 54 bp, Artificial Sequence
  Description of Artificial Sequence: Synthetic oligonucleotide
gaaaatgcggccaacaccgtggcgcacgcccgtaaagccattcacaaaattctg

SEQ ID NO: 4134 - DNA, 54 bp, Artificial Sequence
  Description of Artificial Sequence: Synthetic oligonucleotide
gaagatctgaagaaggtgggcaatcgcgttctgaccgccctgggtggcattctg

SEQ ID NO: 4135 - DNA, 54 bp, Artificial Sequence
  Description of Artificial Sequence: Synthetic oligonucleotide
gaagatctgaagaagcatggcgtgacgttcctgaccgccctgggtgcgattctg

SEQ ID NO: 4136 - DNA, 54 bp, Artificial Sequence
  Description of Artificial Sequence: Synthetic oligonucleotide
gaagatctgaagaagcatggcgtgacggccctgaccgccctgggtgcgattctg

SEQ ID NO: 4137 - DNA, 54 bp, Artificial Sequence
  Description of Artificial Sequence: Synthetic oligonucleotide
gtgcaggatatcaagaataatctgaaggaggcgattgagaccatcgtggcggcg

SEQ ID NO: 4138 - DNA, 54 bp, Artificial Sequence
  Description of Artificial Sequence: Synthetic oligonucleotide
ggcgaaagccgcgttattagcgtggccgaggtgaaaggtctggttgaacagtgg

SEQ ID NO: 4139 - DNA, 54 bp, Artificial Sequence
  Description of Artificial Sequence: Synthetic oligonucleotide
gcggcgcaggttaaggatgcgctgacgaagatgcgtgcggccgcgttagatgcg

SEQ ID NO: 4140 - DNA, 54 bp, Artificial Sequence
  Description of Artificial Sequence: Synthetic oligonucleotide
gaagatctgaagaagcatggcgcgacggttctgaccgccctgggtggcattctg

SEQ ID NO: 4141 - DNA, 54 bp, Artificial Sequence
  Description of Artificial Sequence: Synthetic oligonucleotide
caggtgaaaggtcacggcaaaaaagttgccgatgcgttaaccaacgcggtggcg

SEQ ID NO: 4142 - DNA, 54 bp, Artificial Sequence
  Description of Artificial Sequence: Synthetic oligonucleotide
gtggtggatcgcttcctggcggatttacaagatgcggttgcgcaagtgcgtgcg

SEQ ID NO: 4143 - DNA, 54 bp, Artificial Sequence
  Description of Artificial Sequence: Synthetic oligonucleotide
gaagatctgaagaaggatggcgtgacgtctctgaccgccctgggtgcgattctg

SEQ ID NO: 4144 - DNA, 54 bp, Artificial Sequence
  Description of Artificial Sequence: Synthetic oligonucleotide
gcggatgaacaacgcagcgtgcgtgccttagtgaccgccaccacggcggtggat

SEQ ID NO: 4145 - DNA, 54 bp, Artificial Sequence
  Description of Artificial Sequence: Synthetic oligonucleotide
gaagaagtgaagaagcatggcaccacggttctgaccgccctgggtcgtattctg

SEQ ID NO: 4146 - DNA, 54 bp, Artificial Sequence
  Description of Artificial Sequence: Synthetic oligonucleotide
gtggatgaaggtgttgatctggtgatccgcgcgatttctgcggccaaacagcgt

SEQ ID NO: 4147 - DNA, 54 bp, Artificial Sequence
  Description of Artificial Sequence: Synthetic oligonucleotide
gcggaaagcatcgccaaagcgcagaagtctcgtgaaatctttgagggcattgcg

SEQ ID NO: 4148 - DNA, 54 bp, Artificial Sequence
  Description of Artificial Sequence: Synthetic oligonucleotide
gaagatctgaagaagcatggcgtgacggttctgaccgccctgggtgcgattctg

SEQ ID NO: 4149 - DNA, 54 bp, Artificial Sequence
  Description of Artificial Sequence: Synthetic oligonucleotide
cgtgatgcgttaatcgaaaattataagacgagcattcgcaatgttggcgcggcg

SEQ ID NO: 4150 - DNA, 54 bp, Artificial Sequence
  Description of Artificial Sequence: Synthetic oligonucleotide
accgaagaattagccgtggatgcgttatacaatgcgatcaaagttcgtctggcg

SEQ ID NO: 4151 - DNA, 54 bp, Artificial Sequence
  Description of Artificial Sequence: Synthetic oligonucleotide
ccgggcaccggtgagattgtggcggaggccgtggatgccgcgatccgtaaaacc

SEQ ID NO: 4152 - DNA, 54 bp, Artificial Sequence
  Description of Artificial Sequence: Synthetic oligonucleotide
ccggaaaccgccgccgataaactgttagccgcgattaacgaacgccgtgcgggc

SEQ ID NO: 4153 - DNA, 54 bp, Artificial Sequence
  Description of Artificial Sequence: Synthetic oligonucleotide
ctgggcgcgtctggtgcgcgtattttaacgaccctggttcatgagatgcgtcgt

SEQ ID NO: 4154 - DNA, 54 bp, Artificial Sequence
  Description of Artificial Sequence: Synthetic oligonucleotide
gaagatctgaagaagcatggcgtgacggttctgaccggtctgggtgcgattctg

SEQ ID NO: 4155 - DNA, 54 bp, Artificial Sequence
  Description of Artificial Sequence: Synthetic oligonucleotide
tatgaaggcgagttaaataaagtgacgtctaatgtggccattggtcgtagccat

SEQ ID NO: 4156 - DNA, 54 bp, Artificial Sequence
  Description of Artificial Sequence: Synthetic oligonucleotide
ggcgcgaccttaacgggcaccgtgcaagacattattcgcgaattagcgcgtcat

SEQ ID NO: 4157 - DNA, 54 bp, Artificial Sequence
  Description of Artificial Sequence: Synthetic oligonucleotide
cgtgcgaaagcctcttttgatacccgcgttgcggcggccgaattagcgctgaat

SEQ ID NO: 4158 - DNA, 54 bp, Artificial Sequence
  Description of Artificial Sequence: Synthetic oligonucleotide
ggcccggaagttatggacgcggcgattcgcgttctgaaaacggtgttagataat

SEQ ID NO: 4159 - DNA, 54 bp, Artificial Sequence
  Description of Artificial Sequence: Synthetic oligonucleotide
cgtagcgaagccgacgatctggcgacgcgcgtggcgaacgcggttcgtgatgcg

SEQ ID NO: 4160 - DNA, 54 bp, Artificial Sequence
  Description of Artificial Sequence: Synthetic oligonucleotide
ggcgcgacccaaaacctgccgaaattagccgaatttatccgtatcgcgaaagaa

SEQ ID NO: 4161 - DNA, 54 bp, Artificial Sequence
  Description of Artificial Sequence: Synthetic oligonucleotide
gtggatggcgccgttcgtatgggccagcgcacggcggcggacattatcgcgcgt

SEQ ID NO: 4162 - DNA, 54 bp, Artificial Sequence
  Description of Artificial Sequence: Synthetic oligonucleotide
catgcgcagatcacggaaaccgcgggtgccgtgaaacgcgcgatgcgcgatgcg

SEQ ID NO: 4163 - DNA, 54 bp, Artificial Sequence
  Description of Artificial Sequence: Synthetic oligonucleotide
gcgaaagaattagttgatcgtagcgtttctctgagcaaggcggttaaagcgatt

SEQ ID NO: 4164 - DNA, 54 bp, Artificial Sequence
  Description of Artificial Sequence: Synthetic oligonucleotide
gaagatctgaagaagcatggcaatacggttctgaccgccctgggtggcattctg

SEQ ID NO: 4165 - DNA, 54 bp, Artificial Sequence
  Description of Artificial Sequence: Synthetic oligonucleotide
ccggaagcgttattaaaacgtgcggacgagggcgtgtaccaggccaaagcgagc

SEQ ID NO: 4166 - DNA, 54 bp, Artificial Sequence
  Description of Artificial Sequence: Synthetic oligonucleotide
gaagtgtatcaaatcctggaaaaaggtgccgcgaaacgcaccacggcggcgacc

SEQ ID NO: 4167 - DNA, 54 bp, Artificial Sequence
  Description of Artificial Sequence: Synthetic oligonucleotide
ctggatgaagttaacaaaaaagcgttccaaggcaccttactggcccatgtggat

SEQ ID NO: 4168 - DNA, 54 bp, Artificial Sequence
  Description of Artificial Sequence: Synthetic oligonucleotide
ggcgataaaaaggccgcgctggtgtcttacattggcgagacccgccagcagctg

SEQ ID NO: 4169 - DNA, 54 bp, Artificial Sequence
  Description of Artificial Sequence: Synthetic oligonucleotide
gaagatctgaagaagcatggcaccgttgttctgaccgccctgggtggcattctg

SEQ ID NO: 4170 - DNA, 54 bp, Artificial Sequence
  Description of Artificial Sequence: Synthetic oligonucleotide
aaagaaagcttagttatggcgggcgatttagttattaaaacggcgaagaaacat

SEQ ID NO: 4171 - DNA, 54 bp, Artificial Sequence
  Description of Artificial Sequence: Synthetic oligonucleotide
aatacctatgttaagggcgcgaatgccgccctggaaaagattgagaaacatctg

SEQ ID NO: 4172 - DNA, 54 bp, Artificial Sequence
  Description of Artificial Sequence: Synthetic oligonucleotide
gaaagcgaaaaggttaatgaaattgttaaggcggtgaagaccgccctgaccggc

SEQ ID NO: 4173 - DNA, 54 bp, Artificial Sequence
  Description of Artificial Sequence: Synthetic oligonucleotide
ggcgcgcaggccttacataccgtgttagacctggaaccagcgttaggcaaacgt

SEQ ID NO: 4174 - DNA, 54 bp, Artificial Sequence
  Description of Artificial Sequence: Synthetic oligonucleotide
gatgaagataaggccgtggatctgatcgtttttaaaaaggcggttctgagcacc

SEQ ID NO: 4175 - DNA, 54 bp, Artificial Sequence
  Description of Artificial Sequence: Synthetic oligonucleotide
gtgggcgcgacgggtggccgtatgctggccacgctggcgcgcgaattacatcgt

SEQ ID NO: 4176 - DNA, 54 bp, Artificial Sequence
  Description of Artificial Sequence: Synthetic oligonucleotide
agcgaagtggacatccaggcgagcatcgcctatgcgaaggcgttagaaaaagcg

SEQ ID NO: 4177 - DNA, 54 bp, Artificial Sequence
  Description of Artificial Sequence: Synthetic oligonucleotide
accgataccgccatcctgctgaaagacgccctggcggccgcgcacgcgcgttat

SEQ ID NO: 4178 - DNA, 54 bp, Artificial Sequence
  Description of Artificial Sequence: Synthetic oligonucleotide
cgtgatctgttagagaccgcgggcaagttaatggcgaaagagagcatcgcgaaa

SEQ ID NO: 4179 - DNA, 57 bp, Artificial Sequence
  Description of Artificial Sequence: Synthetic oligonucleotide
gaagatctgaagaagcagggcgtgacggttctgaccgccctgggtgcgattttaaaa

SEQ ID NO: 4180 - DNA, 57 bp, Artificial Sequence
  Description of Artificial Sequence: Synthetic oligonucleotide
gcggcgcaggttaaggatgcgctgacgaagatgcgtgcggccgcgttagatgcgcag

SEQ ID NO: 4181 - DNA, 57 bp, Artificial Sequence
  Description of Artificial Sequence: Synthetic oligonucleotide
accaaagcgggtgttctggcggatgccttagataaagccaccgagaaactgttaaat

SEQ ID NO: 4182 - DNA, 57 bp, Artificial Sequence
  Description of Artificial Sequence: Synthetic oligonucleotide
gaagatctgaagaaggatggcgtgacggccctgaccgccctgggtgcgattttaaaa

SEQ ID NO: 4183 - DNA, 57 bp, Artificial Sequence
  Description of Artificial Sequence: Synthetic oligonucleotide
gaagatctgaaggagcatggcaccgttgttctgaccgccctgggtggcattttaaaa

SEQ ID NO: 4184 - DNA, 57 bp, Artificial Sequence
  Description of Artificial Sequence: Synthetic oligonucleotide
gaagatctgaagaaggtgggcaatacgacgctgaccgccctgggtggcattttaaaa

SEQ ID NO: 4185 - DNA, 57 bp, Artificial Sequence
  Description of Artificial Sequence: Synthetic oligonucleotide
gatgcggaattaaacagcctggcgaagggtgcggtgaaggaattagcgagcttatat

SEQ ID NO: 4186 - DNA, 57 bp, Artificial Sequence
  Description of Artificial Sequence: Synthetic oligonucleotide
aatagcgcgatcggttatgaagaagccgccaaagtggccaaacaagcgctggccgaa

SEQ ID NO: 4187 - DNA, 57 bp, Artificial Sequence
  Description of Artificial Sequence: Synthetic oligonucleotide
accggcccggccatcgatcatgcggccgacctgctgttaagccacgcgcgtaacgtg

SEQ ID NO: 4188 - DNA, 57 bp, Artificial Sequence
  Description of Artificial Sequence: Synthetic oligonucleotide
gcggaagaattagacaaagtggcgcgcttagcggcgaaggcgttagcgagcgttagc

SEQ ID NO: 4189 - DNA, 57 bp, Artificial Sequence
  Description of Artificial Sequence: Synthetic oligonucleotide
ggcgaactggccaagcatgcggtgtctgagggcaccaaggcggttaccaaatacacc

SEQ ID NO: 4190 - DNA, 57 bp, Artificial Sequence
  Description of Artificial Sequence: Synthetic oligonucleotide
gatgcggatttagccgcggcggtggagtctgcgaaagccgcgcaaccgaaatgggcg

SEQ ID NO: 4191 - DNA, 57 bp, Artificial Sequence
  Description of Artificial Sequence: Synthetic oligonucleotide
gaaaaagcgaaggttctggcgaaagccttagataccgccaccggtaaactgttagaa

SEQ ID NO: 4192 - DNA, 57 bp, Artificial Sequence
  Description of Artificial Sequence: Synthetic oligonucleotide
gatgcggaacaagcccaggaactggcccgcattgcgaaggcggccacctttgccgcg

SEQ ID NO: 4193 - DNA, 57 bp, Artificial Sequence
  Description of Artificial Sequence: Synthetic oligonucleotide
attgatagcacgatcaaaagcggcttaacggcggcgcgcgatgttaatcgtgccagc

SEQ ID NO: 4194 - DNA, 57 bp, Artificial Sequence
  Description of Artificial Sequence: Synthetic oligonucleotide
gaagatctgaagaagcatggcgtgacggttctgaccggtctgggtgcgattttaaaa

SEQ ID NO: 4195 - DNA, 57 bp, Artificial Sequence
  Description of Artificial Sequence: Synthetic oligonucleotide
ggcggcggcacggacctgggcaaattcgttctggcgaagaaagaggaaaatgccaaa

SEQ ID NO: 4196 - DNA, 57 bp, Artificial Sequence
  Description of Artificial Sequence: Synthetic oligonucleotide
ccgagcgtgggttctctggcggaaaaggttgatgcggagcgtatcgcgattgccaaa

SEQ ID NO: 4197 - DNA, 57 bp, Artificial Sequence
  Description of Artificial Sequence: Synthetic oligonucleotide
gaagatctgaagaagctgggcgtgacggttctgaccgccctgggtgcgattttaaaa

SEQ ID NO: 4198 - DNA, 57 bp, Artificial Sequence
  Description of Artificial Sequence: Synthetic oligonucleotide
gcgcaggtgaagggtcatggcaaaaaggttgcggatgccctgacgaatgcggttgcg

SEQ ID NO: 4199 - DNA, 57 bp, Artificial Sequence
  Description of Artificial Sequence: Synthetic oligonucleotide
aaactgctgtctgccgcgaaaattttagccgatgcgacggcgaagatggtggaagcg

SEQ ID NO: 4200 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAADPLDEWDAYLFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEAWESDTRIFGQGTKVEIK

SEQ ID NO: 4201 - protein, 243 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAGSTYDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDNNVVFGQGTKVEIK

SEQ ID NO: 4202 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAGSTYDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSGVVFGQGTKVEIK

SEQ ID NO: 4203 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAHGGTNSRGWKALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTTPTVVFGQGTKVEIK

SEQ ID NO: 4204 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGAGSSAASGFATWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGAASGVFGQGTKVEIK

SEQ ID NO: 4205 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDEVWIAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGHVVFGQGTKVEIK

SEQ ID NO: 4206 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRGGDVVTAGRGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPPITFGQGTKVEIK

SEQ ID NO: 4207 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRWDFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDKPYVFGQGTKVEIK

SEQ ID NO: 4208 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILAYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4209 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILAYGSASDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4210 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILTYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDGGSDHWVFGQGTKVEIK

SEQ ID NO: 4211 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILTYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDNGSDHWVFGQGTKVEIK

SEQ ID NO: 4212 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILTYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSISDHWVFGQGTKVEIK

SEQ ID NO: 4213 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILTYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4214 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNDILTYGSAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDTNTDHWLFGQGTKVEIK

SEQ ID NO: 4215 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNRYSYGDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDLSGWVFGQGTKVEIK

SEQ ID NO: 4216 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCANGRSSAYFNHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPYTFGQGTKVEIK

SEQ ID NO: 4217 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPNSNSPSYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHMWNASRNHWVFGQGTKVEIK

SEQ ID NO: 4218 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPNSNSPSYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHVWDSSGDHWVFGQGTKVEIK

SEQ ID NO: 4219 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARANVYQQTWAFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGERWPLAFGQGTKVEIK

SEQ ID NO: 4220 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARARGANTWDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEYSFPVTFGQGTKVEIK

SEQ ID NO: 4221 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDFHRAYGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 4222 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGSRDYGAGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGNTHLVFGQGTKVEIK

SEQ ID NO: 4223 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPRGDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYHTTPPTFGQGTKVEIK

SEQ ID NO: 4224 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYSGYGLRYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDHNSVVFGQGTKVEIK

SEQ ID NO: 4225 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRTSRAALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGDTHLVFGQGTKVEIK

SEQ ID NO: 4226 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDTGFGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTWGFGQGTKVEIK

SEQ ID NO: 4227 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDTSSGAMDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSFGGNDNLIFGQGTKVEIK

SEQ ID NO: 4228 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVQYRFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGQNKQFPWTFGQGTKVEIK

SEQ ID NO: 4229 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDWWGAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQFNSLGWIFGQGTKVEIK

SEQ ID NO: 4230 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEGSSPITFGQGTKVEIK

SEQ ID NO: 4231 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDTTPPLTFGQGTKVEIK

SEQ ID NO: 4232 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPITFGQGTKVEIK

SEQ ID NO: 4233 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDFGLGIMVFGQGTKVEIK

SEQ ID NO: 4234 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDISNLSHVVFGQGTKVEIK

SEQ ID NO: 4235 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGGDYGSGYYLPNYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSKVFGQGTKVEIK

SEQ ID NO: 4236 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWGGSWFGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSSSITFGQGTKVEIK

SEQ ID NO: 4237 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWGGSWFGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSNAVFGQGTKVEIK

SEQ ID NO: 4238 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWLGTTGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSAPFYVFGQGTKVEIK

SEQ ID NO: 4239 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWLGTTGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSGPLKVFGQGTKVEIK

SEQ ID NO: 4240 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREYYGIDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSSPNVVFGQGTKVEIK

SEQ ID NO: 4241 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFGVGYDTHYMYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQFHSFPLTFGQGTKVEIK

SEQ ID NO: 4242 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGDFLFRYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTPFYVFGQGTKVEIK

SEQ ID NO: 4243 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGDSSGWDYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPPITFGQGTKVEIK

SEQ ID NO: 4244 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGASIGVFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGMVFGQGTKVEIK

SEQ ID NO: 4245 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGSVDIAYGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPLTFGQGTKVEIK

SEQ ID NO: 4246 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLIMTPGYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGGLVFGQGTKVEIK

SEQ ID NO: 4247 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGYSYAAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQDYSFPPTFGQGTKVEIK

SEQ ID NO: 4248 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPRFGELPFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSNTTWLFGQGTKVEIK

SEQ ID NO: 4249 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYLASSSAHGGYYALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPISFGQGTKVEIK

SEQ ID NO: 4250 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYLASSSAHGGYYALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 4251 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYRNLSYDDDDFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTGVVFGQGTKVEIK

SEQ ID NO: 4252 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSVSTGIAFYYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSLVFGQGTKVEIK

SEQ ID NO: 4253 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHDFSTGAYDWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGARWPLAFGQGTKVEIK

SEQ ID NO: 4254 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLGYKGFAYLGSYSSYAFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPITFGQGTKVEIK

SEQ ID NO: 4255 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLSGTYYYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDRLPLTFGQGTKVEIK

SEQ ID NO: 4256 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLYHTAYRYTYYFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHVWDSSDVVFGQGTKVEIK

SEQ ID NO: 4257 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMRWGIYRGKLSVYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGVFGQGTKVEIK

SEQ ID NO: 4258 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMSRYGAFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPLTFGQGTKVEIK

SEQ ID NO: 4259 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNHHSDFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQEYNAYPTTFGQGTKVEIK

SEQ ID NO: 4260 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNHHSDFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTVTPPFTFGQGTKVEIK

SEQ ID NO: 4261 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNHHSDFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPRTFGQGTKVEIK

SEQ ID NO: 4262 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNHHSDFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPRTFGQGTKVEIK

SEQ ID NO: 4263 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRGTGDLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDNGSDHLVVFGQGTKVEIK

SEQ ID NO: 4264 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRGTGDLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHLVVFGQGTKVEIK

SEQ ID NO: 4265 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGDLNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSSSLVVFGQGTKVEIK

SEQ ID NO: 4266 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGDLNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDTSTSSHVVFGQGTKVEIK

SEQ ID NO: 4267 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGDLNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSASPHVVFGQGTKVEIK

SEQ ID NO: 4268 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGDLNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDGLVVFGQGTKVEIK

SEQ ID NO: 4269 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGELKPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDTSGNHPVVFGQGTKVEIK

SEQ ID NO: 4270 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGELNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDASSDPFVVFGQGTKVEIK

SEQ ID NO: 4271 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGELNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHHVVFGQGTKVEIK

SEQ ID NO: 4272 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGELNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSPVVVFGQGTKVEIK

SEQ ID NO: 4273 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNWNDFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQRYESSPRTFGQGTKVEIK

SEQ ID NO: 4274 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPLPNVGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLLSYVFGQGTKVEIK

SEQ ID NO: 4275 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARQGWLATTRGMDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAGDRTTGQFGQGTKVEIK

SEQ ID NO: 4276 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARQKLRGDGFDTWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYGGPFTFGQGTKVEIK

SEQ ID NO: 4277 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSGNSYGQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGHVVFGQGTKVEIK

SEQ ID NO: 4278 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSGQYGGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEYSFPVTFGQGTKVEIK

SEQ ID NO: 4279 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTAAYVLGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSIPFTFGQGTKVEIK

SEQ ID NO: 4280 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTAAYVLGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSIPLTFGQGTKVEIK

SEQ ID NO: 4281 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRIGYSHHADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCYSYVGSSTWVFGQGTKVEIK

SEQ ID NO: 4282 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGAAAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTLDSILRSWVFGQGTKVEIK

SEQ ID NO: 4283 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAISFPLTFGQGTKVEIK

SEQ ID NO: 4284 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPITFGQGTKVEIK

SEQ ID NO: 4285 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPLTFGQGTKVEIK

SEQ ID NO: 4286 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 4287 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSFPPTFGQGTKVEIK

SEQ ID NO: 4288 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQGINWPLTFGQGTKVEIK

SEQ ID NO: 4289 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGSGIVFGQGTKVEIK

SEQ ID NO: 4290 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWNIAIVGAAPVPVMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPLTFGQGTKVEIK

SEQ ID NO: 4291 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWNIAIVGAAPVPVMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPVSFGQGTKVEIK

SEQ ID NO: 4292 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWNIAIVGAAPVPVMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPVTFGQGTKVEIK

SEQ ID NO: 4293 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYGSNYRYFDRWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGSHWPWAFGQGTKVEIK

SEQ ID NO: 4294 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASAGPDDDFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTGVVFGQGTKVEIK

SEQ ID NO: 4295 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASAGPDDDFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTVFGQGTKVEIK

SEQ ID NO: 4296 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASPKYGDFYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHYAIPLTFGQGTKVEIK

SEQ ID NO: 4297 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATNDWWGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSQSNSWVFGQGTKVEIK

SEQ ID NO: 4298 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATYDVLTGFEYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRVFGQGTKVEIK

SEQ ID NO: 4299 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATYLGGIVGASDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEYTAPVTFGQGTKVEIK

SEQ ID NO: 4300 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSGGELARGFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSVTIPRTFGQGTKVEIK

SEQ ID NO: 4301 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRHSGWLFPSAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQNWGTGVGGFGQGTKVEIK

SEQ ID NO: 4302 - protein, 251 aa, Artificial Sequence; identical to SEQ ID NO: 4200
  Description of Artificial Sequence: Synthetic polypeptide

SEQ ID NO: 4303 - protein, 243 aa, Artificial Sequence; identical to SEQ ID NO: 4201
  Description of Artificial Sequence: Synthetic polypeptide

SEQ ID NO: 4304 - protein, 245 aa, Artificial Sequence; identical to SEQ ID NO: 4202
  Description of Artificial Sequence: Synthetic polypeptide

SEQ ID NO: 4305 - protein, 254 aa, Artificial Sequence; identical to SEQ ID NO: 4203
  Description of Artificial Sequence: Synthetic polypeptide

SEQ ID NO: 4306 - protein, 249 aa, Artificial Sequence; identical to SEQ ID NO: 4204
  Description of Artificial Sequence: Synthetic polypeptide

SEQ ID NO: 4307 - protein, 248 aa, Artificial Sequence; identical to SEQ ID NO: 4205
  Description of Artificial Sequence: Synthetic polypeptide

SEQ ID NO: 4308 - protein, 254 aa, Artificial Sequence; identical to SEQ ID NO: 4206
  Description of Artificial Sequence: Synthetic polypeptide

SEQ ID NO: 4309 - protein, 248 aa, Artificial Sequence; identical to SEQ ID NO: 4207
  Description of Artificial Sequence: Synthetic polypeptide

SEQ ID NO: 4310 - protein, 252 aa, Artificial Sequence; identical to SEQ ID NO: 4208
  Description of Artificial Sequence: Synthetic polypeptide

SEQ ID NO: 4311 - protein, 252 aa, Artificial Sequence; identical to SEQ ID NO: 4209
  Description of Artificial Sequence: Synthetic polypeptide

SEQ ID NO: 4312 - protein, 252 aa, Artificial Sequence; identical to SEQ ID NO: 4210
  Description of Artificial Sequence: Synthetic polypeptide

SEQ ID NO: 4313 - protein, 252 aa, Artificial Sequence; identical to SEQ ID NO: 4211
  Description of Artificial Sequence: Synthetic polypeptide

SEQ ID NO: 4314 - protein, 252 aa, Artificial Sequence; identical to SEQ ID NO: 4212
  Description of Artificial Sequence: Synthetic polypeptide

SEQ ID NO: 4315 - protein, 252 aa, Artificial Sequence; identical to SEQ ID NO: 4213
  Description of Artificial Sequence: Synthetic polypeptide

SEQ ID NO: 4316 - protein, 252 aa, Artificial Sequence; identical to SEQ ID NO: 4214
  Description of Artificial Sequence: Synthetic polypeptide

SEQ ID NO: 4317 - protein, 247 aa, Artificial Sequence; identical to SEQ ID NO: 4215
  Description of Artificial Sequence: Synthetic polypeptide

SEQ ID NO: 4318 - protein, 247 aa, Artificial Sequence; identical to SEQ ID NO: 4216
  Description of Artificial Sequence: Synthetic polypeptide

SEQ ID NO: 4319 - protein, 247 aa, Artificial Sequence; identical to SEQ ID NO: 4217
  Description of Artificial Sequence: Synthetic polypeptide

SEQ ID NO: 4320 - protein, 247 aa, Artificial Sequence; identical to SEQ ID NO: 4218
  Description of Artificial Sequence: Synthetic polypeptide

SEQ ID NO: 4321 - protein, 250 aa, Artificial Sequence; identical to SEQ ID NO: 4219
  Description of Artificial Sequence: Synthetic polypeptide

SEQ ID NO: 4322 - protein, 247 aa, Artificial Sequence; identical to SEQ ID NO: 4220
  Description of Artificial Sequence: Synthetic polypeptide

SEQ ID NO: 4323 - protein, 248 aa, Artificial Sequence; identical to SEQ ID NO: 4221
  Description of Artificial Sequence: Synthetic polypeptide

SEQ ID NO: 4324 - protein, 250 aa, Artificial Sequence; identical to SEQ ID NO: 4222
  Description of Artificial Sequence: Synthetic polypeptide

SEQ ID NO: 4325 - protein, 247 aa, Artificial Sequence; identical to SEQ ID NO: 4223
  Description of Artificial Sequence: Synthetic polypeptide

SEQ ID NO: 4326 - protein, 248 aa, Artificial Sequence; identical to SEQ ID NO: 4225
  Description of Artificial Sequence: Synthetic polypeptide

SEQ ID NO: 4327 - protein, 248 aa, Artificial Sequence; identical to SEQ ID NO: 4226
  Description of Artificial Sequence: Synthetic polypeptide

SEQ ID NO: 4328 - protein, 248 aa, Artificial Sequence; identical to SEQ ID NO: 4227
  Description of Artificial Sequence: Synthetic polypeptide

SEQ ID NO: 4329 - protein, 246 aa, Artificial Sequence; identical to SEQ ID NO: 4228
  Description of Artificial Sequence: Synthetic polypeptide

SEQ ID NO: 4330 - protein, 257 aa, Artificial Sequence; identical to SEQ ID NO: 4230
  Description of Artificial Sequence: Synthetic polypeptide

SEQ ID NO: 4331 - protein, 258 aa, Artificial Sequence; identical to SEQ ID NO: 4231
  Description of Artificial Sequence: Synthetic polypeptide

SEQ ID NO: 4332 - protein, 257 aa, Artificial Sequence; identical to SEQ ID NO: 4232
  Description of Artificial Sequence: Synthetic polypeptide

SEQ ID NO: 4333 - protein, 259 aa, Artificial Sequence; identical to SEQ ID NO: 4233
  Description of Artificial Sequence: Synthetic polypeptide

SEQ ID NO: 4334 - protein, 260 aa, Artificial Sequence; identical to SEQ ID NO: 4234
  Description of Artificial Sequence: Synthetic polypeptide

SEQ ID NO: 4335 - protein, 257 aa, Artificial Sequence; identical to SEQ ID NO: 4235
  Description of Artificial Sequence: Synthetic polypeptide

SEQ ID NO: 4336 - protein, 249 aa, Artificial Sequence; identical to SEQ ID NO: 4236
  Description of Artificial Sequence: Synthetic polypeptide

SEQ ID NO: 4337 - protein, 249 aa, Artificial Sequence; identical to SEQ ID NO: 4237
  Description of Artificial Sequence: Synthetic polypeptide

SEQ ID NO: 4338 - protein, 251 aa, Artificial Sequence; identical to SEQ ID NO: 4238
  Description of Artificial Sequence: Synthetic polypeptide

SEQ ID NO: 4339 - protein, 251 aa, Artificial Sequence; identical to SEQ ID NO: 4239
  Description of Artificial Sequence: Synthetic polypeptide

SEQ ID NO: 4340 - protein, 249 aa, Artificial Sequence; identical to SEQ ID NO: 4240
  Description of Artificial Sequence: Synthetic polypeptide

SEQ ID NO: 4341 - protein, 252 aa, Artificial Sequence; identical to SEQ ID NO: 4241
  Description of Artificial Sequence: Synthetic polypeptide

SEQ ID NO: 4342 - protein, 247 aa, Artificial Sequence; identical to SEQ ID NO: 4242
  Description of Artificial Sequence: Synthetic polypeptide

SEQ ID NO: 4343 - protein, 250 aa, Artificial Sequence; identical to SEQ ID NO: 4243
  Description of Artificial Sequence: Synthetic polypeptide

SEQ ID NO: 4344 - protein, 247 aa, Artificial Sequence; identical to SEQ ID NO: 4244
  Description of Artificial Sequence: Synthetic polypeptide

SEQ ID NO: 4345 - protein, 249 aa, Artificial Sequence; identical to SEQ ID NO: 4246
  Description of Artificial Sequence: Synthetic polypeptide

SEQ ID NO: 4346 - protein, 249 aa, Artificial Sequence; identical to SEQ ID NO: 4247
  Description of Artificial Sequence: Synthetic polypeptide

SEQ ID NO: 4347 - protein, 250 aa, Artificial Sequence; identical to SEQ ID NO: 4248
  Description of Artificial Sequence: Synthetic polypeptide

SEQ ID NO: 4348 - protein, 256 aa, Artificial Sequence; identical to SEQ ID NO: 4249
  Description of Artificial Sequence: Synthetic polypeptide

SEQ ID NO: 4349 - protein, 256 aa, Artificial Sequence; identical to SEQ ID NO: 4250
  Description of Artificial Sequence: Synthetic polypeptide

SEQ ID NO: 4350 - protein, 254 aa, Artificial Sequence; identical to SEQ ID NO: 4251
  Description of Artificial Sequence: Synthetic polypeptide

SEQ ID NO: 4351 - protein, 250 aa, Artificial Sequence; identical to SEQ ID NO: 4252
  Description of Artificial Sequence: Synthetic polypeptide

SEQ ID NO: 4352 - protein, 247 aa, Artificial Sequence; identical to SEQ ID NO: 4253
  Description of Artificial Sequence: Synthetic polypeptide

SEQ ID NO: 4353 - protein, 257 aa, Artificial Sequence; identical to SEQ ID NO: 4254
  Description of Artificial Sequence: Synthetic polypeptide

SEQ ID NO: 4354 - protein, 249 aa, Artificial Sequence; identical to SEQ ID NO: 4255
  Description of Artificial Sequence: Synthetic polypeptide

SEQ ID NO: 4355 - protein, 252 aa, Artificial Sequence; identical to SEQ ID NO: 4256
  Description of Artificial Sequence: Synthetic polypeptide

SEQ ID NO: 4356 - protein, 255 aa, Artificial Sequence; identical to SEQ ID NO: 4257
  Description of Artificial Sequence: Synthetic polypeptide

SEQ ID NO: 4357 - protein, 247 aa, Artificial Sequence; identical to SEQ ID NO: 4258
  Description of Artificial Sequence: Synthetic polypeptide

SEQ ID NO: 4358 - protein, 246 aa, Artificial Sequence; identical to SEQ ID NO: 4259
  Description of Artificial Sequence: Synthetic polypeptide

SEQ ID NO: 4359 - protein, 246 aa, Artificial Sequence; identical to SEQ ID NO: 4260
  Description of Artificial Sequence: Synthetic polypeptide

SEQ ID NO: 4360 - protein, 246 aa, Artificial Sequence; identical to SEQ ID NO: 4261
  Description of Artificial Sequence: Synthetic polypeptide

SEQ ID NO: 4361 - protein, 246 aa, Artificial Sequence; identical to SEQ ID NO: 4262
  Description of Artificial Sequence: Synthetic polypeptide

SEQ ID NO: 4362 - protein, 250 aa, Artificial Sequence; identical to SEQ ID NO: 4263
  Description of Artificial Sequence: Synthetic polypeptide

SEQ ID NO: 4363 - protein, 250 aa, Artificial Sequence; identical to SEQ ID NO: 4264
  Description of Artificial Sequence: Synthetic polypeptide

SEQ ID NO: 4364 - protein, 252 aa, Artificial Sequence; identical to SEQ ID NO: 4265
  Description of Artificial Sequence: Synthetic polypeptide

SEQ ID NO: 4365 - protein, 250 aa, Artificial Sequence; identical to SEQ ID NO: 4266
  Description of Artificial Sequence: Synthetic polypeptide

SEQ ID NO: 4366 - protein, 250 aa, Artificial Sequence; identical to SEQ ID NO: 4267
  Description of Artificial Sequence: Synthetic polypeptide

SEQ ID NO: 4367 - protein, 250 aa, Artificial Sequence; identical to SEQ ID NO: 4268
  Description of Artificial Sequence: Synthetic polypeptide

SEQ ID NO: 4368 - protein, 250 aa, Artificial Sequence; identical to SEQ ID NO: 4269
  Description of Artificial Sequence: Synthetic polypeptide

SEQ ID NO: 4369 - protein, 250 aa, Artificial Sequence; identical to SEQ ID NO: 4270
  Description of Artificial Sequence: Synthetic polypeptide

SEQ ID NO: 4370 - protein, 250 aa, Artificial Sequence; identical to SEQ ID NO: 4271
  Description of Artificial Sequence: Synthetic polypeptide

SEQ ID NO: 4371 - protein, 249 aa, Artificial Sequence; identical to SEQ ID NO: 4272
  Description of Artificial Sequence: Synthetic polypeptide

SEQ ID NO: 4372 - protein, 245 aa, Artificial Sequence; identical to SEQ ID NO: 4273
  Description of Artificial Sequence: Synthetic polypeptide

SEQ ID NO: 4373 - protein, 252 aa, Artificial Sequence; identical to SEQ ID NO: 4274
  Description of Artificial Sequence: Synthetic polypeptide

SEQ ID NO: 4374 - protein, 250 aa, Artificial Sequence; identical to SEQ ID NO: 4275
  Description of Artificial Sequence: Synthetic polypeptide

SEQ ID NO: 4375 - protein, 247 aa, Artificial Sequence; identical to SEQ ID NO: 4276
  Description of Artificial Sequence: Synthetic polypeptide

SEQ ID NO: 4376 - protein, 248 aa, Artificial Sequence; identical to SEQ ID NO: 4278
  Description of Artificial Sequence: Synthetic polypeptide

SEQ ID NO: 4377 - protein, 246 aa, Artificial Sequence; identical to SEQ ID NO: 4279
  Description of Artificial Sequence: Synthetic polypeptide

SEQ ID NO: 4378 - protein, 246 aa, Artificial Sequence; identical to SEQ ID NO: 4280
  Description of Artificial Sequence: Synthetic polypeptide

SEQ ID NO: 4379 - protein, 250 aa, Artificial Sequence; identical to SEQ ID NO: 4281
  Description of Artificial Sequence: Synthetic polypeptide

SEQ ID NO: 4380 - protein, 250 aa, Artificial Sequence; identical to SEQ ID NO: 4283
  Description of Artificial Sequence: Synthetic polypeptide

SEQ ID NO: 4381 - protein, 250 aa, Artificial Sequence; identical to SEQ ID NO: 4284
  Description of Artificial Sequence: Synthetic polypeptide

SEQ ID NO: 4382 - protein, 250 aa, Artificial Sequence; identical to SEQ ID NO: 4285
  Description of Artificial Sequence: Synthetic polypeptide

SEQ ID NO: 4383 - protein, 250 aa, Artificial Sequence; identical to SEQ ID NO: 4286
  Description of Artificial Sequence: Synthetic polypeptide

SEQ ID NO: 4384 - protein, 250 aa, Artificial Sequence; identical to SEQ ID NO: 4287
  Description of Artificial Sequence: Synthetic polypeptide

SEQ ID NO: 4385 - protein, 250 aa, Artificial Sequence; identical to SEQ ID NO: 4288
  Description of Artificial Sequence: Synthetic polypeptide

SEQ ID NO: 4386 - protein, 249 aa, Artificial Sequence; identical to SEQ ID NO: 4289
  Description of Artificial Sequence: Synthetic polypeptide

SEQ ID NO: 4387 - protein, 254 aa, Artificial Sequence; identical to SEQ ID NO: 4290
  Description of Artificial Sequence: Synthetic polypeptide

SEQ ID NO: 4388 - protein, 254 aa, Artificial Sequence; identical to SEQ ID NO: 4291
  Description of Artificial Sequence: Synthetic polypeptide

SEQ ID NO: 4389 - protein, 254 aa, Artificial Sequence; identical to SEQ ID NO: 4292
  Description of Artificial Sequence: Synthetic polypeptide

SEQ ID NO: 4390 - protein, 248 aa, Artificial Sequence; identical to SEQ ID NO: 4293
  Description of Artificial Sequence: Synthetic polypeptide

SEQ ID NO: 4391 - protein, 248 aa, Artificial Sequence; identical to SEQ ID NO: 4294
  Description of Artificial Sequence: Synthetic polypeptide

SEQ ID NO: 4392 - protein, 246 aa, Artificial Sequence; identical to SEQ ID NO: 4295
  Description of Artificial Sequence: Synthetic polypeptide

SEQ ID NO: 4393 - protein, 248 aa, Artificial Sequence; identical to SEQ ID NO: 4296
  Description of Artificial Sequence: Synthetic polypeptide

SEQ ID NO: 4394 - protein, 246 aa, Artificial Sequence; identical to SEQ ID NO: 4297
  Description of Artificial Sequence: Synthetic polypeptide

SEQ ID NO: 4395 - protein, 249 aa, Artificial Sequence; identical to SEQ ID NO: 4299
  Description of Artificial Sequence: Synthetic polypeptide

SEQ ID NO: 4396 - protein, 250 aa, Artificial Sequence; identical to SEQ ID NO: 4301
  Description of Artificial Sequence: Synthetic polypeptide

SEQ ID NO: 4397 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAAKNGASLGVNLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGSPVVFGQGTKVEIK

SEQ ID NO: 4398 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDNSLSAVVFGQGTKVEIK

SEQ ID NO: 4399 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLSWDSSLSAEVFGQGTKVEIK

SEQ ID NO: 4400 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTRGVFGQGTKVEIK

SEQ ID NO: 4401 - protein, 243 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSVPWTFGQGTKVEIK

SEQ ID NO: 4402 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWDAGTNRVFGQGTKVEIK

SEQ ID NO: 4403 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHPVFGQGTKVEIK

SEQ ID NO: 4404 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADNGPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4405 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADTAYSLPVDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYDNWPPTFGQGTKVEIK

SEQ ID NO: 4406 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGDSSSSMPYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQDGTPPRTFGQGTKVEIK

SEQ ID NO: 4407 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGGGNYGQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQADSPPITFGQGTKVEIK

SEQ ID NO: 4408 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGGGNYGQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSPPITFGQGTKVEIK

SEQ ID NO: 4409 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGGGNYGQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4410 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGVGRIFPYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPFTFGQGTKVEIK

SEQ ID NO: 4411 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGVGRIFPYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTYMTPLTFGQGTKVEIK

SEQ ID NO: 4412 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAHRLANYTRVDRYYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWHSGDNRWVFGQGTKVEIK

SEQ ID NO: 4413 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAHSRSISPYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYYSGAFGQGTKVEIK

SEQ ID NO: 4414 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKALYGGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTTFTFGQGTKVEIK

SEQ ID NO: 4415 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAPFWPRSYTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSHHSRVFGQGTKVEIK

SEQ ID NO: 4416 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAVALGWAFDRWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAGVFGQGTKVEIK

SEQ ID NO: 4417 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDAPSGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPRTFGQGTKVEIK

SEQ ID NO: 4418 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDFRGGGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNLLWTFGQGTKVEIK

SEQ ID NO: 4419 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDFRGGGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYLWTFGQGTKVEIK

SEQ ID NO: 4420 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGAVTYGALGDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDISSTYVFGQGTKVEIK

SEQ ID NO: 4421 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGAVNFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTSGTQVVFGQGTKVEIK

SEQ ID NO: 4422 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLLSYSSVRVFGQGTKVEIK

SEQ ID NO: 4423 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPAWTFGQGTKVEIK

SEQ ID NO: 4424 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSGLRGKVFGQGTKVEIK

SEQ ID NO: 4425 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSRSGYVFGQGTKVEIK

SEQ ID NO: 4426 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDNSSDPHYVFGQGTKVEIK

SEQ ID NO: 4427 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGLYRYFYYYKVGDAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSADSSGTYPWVFGQGTKVEIK

SEQ ID NO: 4428 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLIDPVFGQGTKVEIK

SEQ ID NO: 4429 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNAVVFGQGTKVEIK

SEQ ID NO: 4430 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSPNGRVFGQGTKVEIK

SEQ ID NO: 4431 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAGWDDSLSGWVFGQGTKVEIK

SEQ ID NO: 4432 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASWDDSLNGRVFGQGTKVEIK

SEQ ID NO: 4433 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGVWDSSVGGWVFGQGTKVEIK

SEQ ID NO: 4434 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNTAVFGQGTKVEIK

SEQ ID NO: 4435 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4436 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLLPGVVFGQGTKVEIK

SEQ ID NO: 4437 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4438 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGRSAAIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSLVVFGQGTKVEIK

SEQ ID NO: 4439 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHSAYRGGFYSYTFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTDHVVFGQGTKVEIK

SEQ ID NO: 4440 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSRGSGVFGQGTKVEIK

SEQ ID NO: 4441 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSRSPVWSFGQGTKVEIK

SEQ ID NO: 4442 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSLYYGGGDRLFGQGTKVEIK

SEQ ID NO: 4443 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDIWYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWAKSGGNRVFGQGTKVEIK

SEQ ID NO: 4444 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLGTGFMQGYWALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSRDSRGNNLWVFGQGTKVEIK

SEQ ID NO: 4445 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIGSSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDIGTYVVFGQGTKVEIK

SEQ ID NO: 4446 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPLVVFGQGTKVEIK

SEQ ID NO: 4447 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTSLVVFGQGTKVEIK

SEQ ID NO: 4448 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHFGSSPKLTFGQGTKVEIK

SEQ ID NO: 4449 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4450 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSFPLTFGQGTKVEIK

SEQ ID NO: 4451 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGVVFGQGTKVEIK

SEQ ID NO: 4452 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSSLVVFGQGTKVEIK

SEQ ID NO: 4453 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4454 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDQGVFGQGTKVEIK

SEQ ID NO: 4455 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLPGTMSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPWTFGQGTKVEIK

SEQ ID NO: 4456 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRFSGVFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDRSSDQYVFGQGTKVEIK

SEQ ID NO: 4457 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRWNNVNNDSYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSGAVVFGQGTKVEIK

SEQ ID NO: 4458 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETGDSNNLVVFGQGTKVEIK

SEQ ID NO: 4459 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSPYVVFGQGTKVEIK

SEQ ID NO: 4460 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDTSTWVFGQGTKVEIK

SEQ ID NO: 4461 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRKNNPRTFGQGTKVEIK

SEQ ID NO: 4462 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPLTFGQGTKVEIK

SEQ ID NO: 4463 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSSSFSPYTFGQGTKVEIK

SEQ ID NO: 4464 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4465 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4466 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTLYTFGQGTKVEIK

SEQ ID NO: 4467 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSTLWTFGQGTKVEIK

SEQ ID NO: 4468 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPLISFGQGTKVEIK

SEQ ID NO: 4469 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNGLRTFGQGTKVEIK

SEQ ID NO: 4470 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSFPLTFGQGTKVEIK

SEQ ID NO: 4471 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4472 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSDSDHVVFGQGTKVEIK

SEQ ID NO: 4473 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSGDQVFGQGTKVEIK

SEQ ID NO: 4474 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQYYGSYPLYAFGQGTKVEIK

SEQ ID NO: 4475 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYSGSSTFWVFGQGTKVEIK

SEQ ID NO: 4476 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLVTGSLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYITPWTFGQGTKVEIK

SEQ ID NO: 4477 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLVVGALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPWTFGQGTKVEIK

SEQ ID NO: 4478 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLVVGALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHKSYPHFTFGQGTKVEIK

SEQ ID NO: 4479 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLVVGALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYKSHSTFGQGTKVEIK

SEQ ID NO: 4480 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLYAISLFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTWVFGQGTKVEIK

SEQ ID NO: 4481 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDQEGYRAYGYNGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSGNWVFGQGTKVEIK

SEQ ID NO: 4482 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDQEGYRAYGYNGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGAHWPWAFGQGTKVEIK

SEQ ID NO: 4483 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRRHTRGTWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCTSYTSSSELYAFGQGTKVEIK

SEQ ID NO: 4484 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRSVVPTYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPSFGQGTKVEIK

SEQ ID NO: 4485 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDSGTHGTFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTLDSILRSWVFGQGTKVEIK

SEQ ID NO: 4486 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEEWDDSLKGQVFGQGTKVEIK

SEQ ID NO: 4487 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLGAGVFGQGTKVEIK

SEQ ID NO: 4488 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLRAVVFGQGTKVEIK

SEQ ID NO: 4489 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGVWDSSGAVVVFGQGTKVEIK

SEQ ID NO: 4490 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQHNSYPWTFGQGTKVEIK

SEQ ID NO: 4491 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSDHVVFGQGTKVEIK

SEQ ID NO: 4492 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTSHVVFGQGTKVEIK

SEQ ID NO: 4493 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSNPYSFGQGTKVEIK

SEQ ID NO: 4494 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4495 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPRTFGQGTKVEIK

SEQ ID NO: 4496 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYKRPLTFGQGTKVEIK

SEQ ID NO: 4497 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSSLPVVFGQGTKVEIK

SEQ ID NO: 4498 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKEMYWQSYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNAWDSTLRQVVFGQGTKVEIK

SEQ ID NO: 4499 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKERRYAGHSVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSGLSYVFGQGTKVEIK

SEQ ID NO: 4500 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKESVSGSRLGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDGYVFGQGTKVEIK

SEQ ID NO: 4501 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTASVVFGQGTKVEIK

SEQ ID NO: 4502 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQLWGTGGDLVFGQGTKVEIK

SEQ ID NO: 4503 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYSSSSSIAWIFGQGTKVEIK

SEQ ID NO: 4504 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKFNPVGGFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSAWVFGQGTKVEIK

SEQ ID NO: 4505 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGWAYIFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSSAVFGQGTKVEIK

SEQ ID NO: 4506 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGYGHSGYAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTLDSSLSLWVFGQGTKVEIK

SEQ ID NO: 4507 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGHSSTYVIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTTGYVFGQGTKVEIK

SEQ ID NO: 4508 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGIPLQYTYGNDRWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYHHWPLTFGQGTKVEIK

SEQ ID NO: 4509 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGLSWAGSYGYVIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPPATFGQGTKVEIK

SEQ ID NO: 4510 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGLWGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTPYVFGQGTKVEIK

SEQ ID NO: 4511 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGSYGSTSGLYVFGQGTKVEIK

SEQ ID NO: 4512 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSLVVFGQGTKVEIK

SEQ ID NO: 4513 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSSLVVFGQGTKVEIK

SEQ ID NO: 4514 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSSSLVVFGQGTKVEIK

SEQ ID NO: 4515 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSSGPLVVFGQGTKVEIK

SEQ ID NO: 4516 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGRGWKGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSTTDLNYVFGQGTKVEIK

SEQ ID NO: 4517 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGTQYRAWWSVRGYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLSYTSTHNWVFGQGTKVEIK

SEQ ID NO: 4518 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGTTRLGDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLGARYVFGQGTKVEIK

SEQ ID NO: 4519 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGTTRLGDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSPDYVFGQGTKVEIK

SEQ ID NO: 4520 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGWGYRGDIYGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSAYTSSSTVFGQGTKVEIK

SEQ ID NO: 4521 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSDHFVFGQGTKVEIK

SEQ ID NO: 4522 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGSRWPLAFGQGTKVEIK

SEQ ID NO: 4523 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTLYTFGQGTKVEIK

SEQ ID NO: 4524 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSADPYTFGQGTKVEIK

SEQ ID NO: 4525 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWDSNTVMFGQGTKVEIK

SEQ ID NO: 4526 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKHGDVDTMAVPFHSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSYVFGQGTKVEIK

SEQ ID NO: 4527 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKHSPSESWPLDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGSWESNVNRFYVFGQGTKVEIK

SEQ ID NO: 4528 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKHTISERPFKPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQGNTPGQTFGQGTKVEIK

SEQ ID NO: 4529 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKIWRRYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSFPPTFGQGTKVEIK

SEQ ID NO: 4530 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKLRVSRDWSTNYQWNPYFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTWVFGQGTKVEIK

SEQ ID NO: 4531 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNYGGSLDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQATWPPQTFGQGTKVEIK

SEQ ID NO: 4532 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKNYGGSLDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNPPPTFGQGTKVEIK

SEQ ID NO: 4533 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRHDALWAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDSNHLRIFGQGTKVEIK

SEQ ID NO: 4534 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRHDALWAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPYTFGQGTKVEIK

SEQ ID NO: 4535 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRHDALWAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSHHVFGQGTKVEIK

SEQ ID NO: 4536 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSGKYRRFGIYPDYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNILPITFGQGTKVEIK

SEQ ID NO: 4537 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSGKYRRFGIYPDYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSQPITFGQGTKVEIK

SEQ ID NO: 4538 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSKTYRTGTPPAPAMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYISSGTYVFGQGTKVEIK

SEQ ID NO: 4539 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSLWGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDNNSGVFGQGTKVEIK

SEQ ID NO: 4540 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSLWGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSSAVFGQGTKVEIK

SEQ ID NO: 4541 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSLWGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVVFGQGTKVEIK

SEQ ID NO: 4542 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSLYGGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSRLNSAVFGQGTKVEIK

SEQ ID NO: 4543 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSSLMVRGDMVPHFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSIVVFGQGTKVEIK

SEQ ID NO: 4544 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVIPEKVAGLDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQLWDDTNTQVLFGQGTKVEIK

SEQ ID NO: 4545 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVIPEKVAGLDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSAHLVFGQGTKVEIK

SEQ ID NO: 4546 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVSAGVGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYTHRGVEVFGQGTKVEIK

SEQ ID NO: 4547 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKYSAPGYADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSLGVFGQGTKVEIK

SEQ ID NO: 4548 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCALGSYWTGPWKDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTDQWVFGQGTKVEIK

SEQ ID NO: 4549 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCANHKPYGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSPNVVFGQGTKVEIK

SEQ ID NO: 4550 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPYADYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYSQYSFGQGTKVEIK

SEQ ID NO: 4551 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPYADYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSQDSSGDFRVFGQGTKVEIK

SEQ ID NO: 4552 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPYADYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDDYVFGQGTKVEIK

SEQ ID NO: 4553 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPYADYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHVVFGQGTKVEIK

SEQ ID NO: 4554 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAPYADYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTVVFGQGTKVEIK

SEQ ID NO: 4555 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGGVPRGYAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTGVFGQGTKVEIK

SEQ ID NO: 4556 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGRSRGWYGFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQASDSSSVVFGQGTKVEIK

SEQ ID NO: 4557 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGVGATPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQALQTPLTFGQGTKVEIK

SEQ ID NO: 4558 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGVGATPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQARQSPLTFGQGTKVEIK

SEQ ID NO: 4559 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARALTWNYPFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQKYYSAPRTFGQGTKVEIK

SEQ ID NO: 4560 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAQGVLTRESYYGGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQENSPPITFGQGTKVEIK

SEQ ID NO: 4561 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARARVGATPTHAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRVWDSSSTWVFGQGTKVEIK

SEQ ID NO: 4562 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARATRYFDWQYRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYSSTSTPYVFGQGTKVEIK

SEQ ID NO: 4563 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARATRYFDWQYRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSVYVFGQGTKVEIK

SEQ ID NO: 4564 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAAYGDVVRPAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCDVAVTDGRWVFGQGTKVEIK

SEQ ID NO: 4565 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAAYGDVVRPAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNPAVVFGQGTKVEIK

SEQ ID NO: 4566 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAAYGDVVRPAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSAVGGSARWVFGQGTKVEIK

SEQ ID NO: 4567 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAFRYDPRGEYGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGNTHLVFGQGTKVEIK

SEQ ID NO: 4568 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDARYVPDDGWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYVFGQGTKVEIK

SEQ ID NO: 4569 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDARYVPDDGWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVGDSSTVLFGQGTKVEIK

SEQ ID NO: 4570 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTLVVFGQGTKVEIK

SEQ ID NO: 4571 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4572 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTYDDNRSAVVFGQGTKVEIK

SEQ ID NO: 4573 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGASGDLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQLNTYPPWTFGQGTKVEIK

SEQ ID NO: 4574 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGGDYGFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDRLPLTFGQGTKVEIK

SEQ ID NO: 4575 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGTAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSPLVVFGQGTKVEIK

SEQ ID NO: 4576 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGYRRTNYWFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSRDSDSHQAVFGQGTKVEIK

SEQ ID NO: 4577 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGRAPASDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSVVFGQGTKVEIK

SEQ ID NO: 4578 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTMYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGDVVFGQGTKVEIK

SEQ ID NO: 4579 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYNSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4580 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSSLSGYVFGQGTKVEIK

SEQ ID NO: 4581 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANRFPFTFGQGTKVEIK

SEQ ID NO: 4582 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDTPMYTFGQGTKVEIK

SEQ ID NO: 4583 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPAYTFGQGTKVEIK

SEQ ID NO: 4584 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4585 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSYPQTFGQGTKVEIK

SEQ ID NO: 4586 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGWLFGQGTKVEIK

SEQ ID NO: 4587 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4588 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSNSSPRVVFGQGTKVEIK

SEQ ID NO: 4589 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDLQGVFGQGTKVEIK

SEQ ID NO: 4590 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTRGFGQGTKVEIK

SEQ ID NO: 4591 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDIGSGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4592 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKEAYRSSNSYWYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSGAGVFGQGTKVEIK

SEQ ID NO: 4593 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKGADTPFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQYHAFASFGQGTKVEIK

SEQ ID NO: 4594 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKGGMVPFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSVPLTFGQGTKVEIK

SEQ ID NO: 4595 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKGGMYGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSLPLTFGQGTKVEIK

SEQ ID NO: 4596 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKSGYRSGHIGIYGGLGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSFWVFGQGTKVEIK

SEQ ID NO: 4597 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLFAYRHVGYGCFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSRLLSGGMFGQGTKVEIK

SEQ ID NO: 4598 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLGNYRSKQVYFNAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRSANVAFGQGTKVEIK

SEQ ID NO: 4599 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGAWGPGGFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYYTPLTFGQGTKVEIK

SEQ ID NO: 4600 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGIAVAANWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDISLSALVFGQGTKVEIK

SEQ ID NO: 4601 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLRASWVFGQGTKVEIK

SEQ ID NO: 4602 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSTTAGVFGQGTKVEIK

SEQ ID NO: 4603 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLTGYRSRSYQWDGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQALTPTISFGQGTKVEIK

SEQ ID NO: 4604 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLTGYRSRSYQWDGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSAYVFGQGTKVEIK

SEQ ID NO: 4605 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLTGYRSRSYQWDGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGYVFGQGTKVEIK

SEQ ID NO: 4606 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDNGAGAFGVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQLNSNPPWTFGQGTKVEIK

SEQ ID NO: 4607 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDNLGYRGTHSGYAMDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTSVVFGQGTKVEIK

SEQ ID NO: 4608 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDNQYGADDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTYTLPITFGQGTKVEIK

SEQ ID NO: 4609 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPALYSGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWGRDTRVFGQGTKVEIK

SEQ ID NO: 4610 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPDSYRSSGTYYFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSPPWTFGQGTKVEIK

SEQ ID NO: 4611 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPHGVMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGEVVFGQGTKVEIK

SEQ ID NO: 4612 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPLGYLDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIHGVFGQGTKVEIK

SEQ ID NO: 4613 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPMATRYYYYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSGLGVFGQGTKVEIK

SEQ ID NO: 4614 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGSLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGTVVFGQGTKVEIK

SEQ ID NO: 4615 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGSLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSSDLHVVFGQGTKVEIK

SEQ ID NO: 4616 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGSSGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSAHVVFGQGTKVEIK

SEQ ID NO: 4617 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGSSGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGPNWVFGQGTKVEIK

SEQ ID NO: 4618 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPTGYRLSSLYYYAGFAYGMDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYVFGQGTKVEIK

SEQ ID NO: 4619 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPTGYRLSSLYYYAGFAYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQETHWPHTFGQGTKVEIK

SEQ ID NO: 4620 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPTRRFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPGVVFGQGTKVEIK

SEQ ID NO: 4621 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQRGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPSVVFGQGTKVEIK

SEQ ID NO: 4622 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQTYYDSSLSYGYAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWGSNTRVFGQGTKVEIK

SEQ ID NO: 4623 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGLVFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCKAWDSSTSVVFGQGTKVEIK

SEQ ID NO: 4624 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGRDGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPLTFGQGTKVEIK

SEQ ID NO: 4625 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLAARWVFGQGTKVEIK

SEQ ID NO: 4626 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSNSAWVFGQGTKVEIK

SEQ ID NO: 4627 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4628 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTFDRSLSGAVFGQGTKVEIK

SEQ ID NO: 4629 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4630 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRSRELFWQFDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTSAVFGQGTKVEIK

SEQ ID NO: 4631 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSYTHTFGQGTKVEIK

SEQ ID NO: 4632 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDSSLLSAAGVFGQGTKVEIK

SEQ ID NO: 4633 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSRLLSGGMFGQGTKVEIK

SEQ ID NO: 4634 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTGVFGQGTKVEIK

SEQ ID NO: 4635 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTDVVFGQGTKVEIK

SEQ ID NO: 4636 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSSPYTFGQGTKVEIK

SEQ ID NO: 4637 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTCDSFGQVFGQGTKVEIK

SEQ ID NO: 4638 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4639 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4640 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRKDFRMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAEWADSLSGGVFGQGTKVEIK

SEQ ID NO: 4641 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTVIFGQGTKVEIK

SEQ ID NO: 4642 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTVVFGQGTKVEIK

SEQ ID NO: 4643 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTGVVFGQGTKVEIK

SEQ ID NO: 4644 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTPDVVFGQGTKVEIK

SEQ ID NO: 4645 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVIFGQGTKVEIK

SEQ ID NO: 4646 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVVFGQGTKVEIK

SEQ ID NO: 4647 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTAGTVFGQGTKVEIK

SEQ ID NO: 4648 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTTAVVFGQGTKVEIK

SEQ ID NO: 4649 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSGDQAVFGQGTKVEIK

SEQ ID NO: 4650 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDQGVFGQGTKVEIK

SEQ ID NO: 4651 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSFNHLVFGQGTKVEIK

SEQ ID NO: 4652 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQATQFPRTFGQGTKVEIK

SEQ ID NO: 4653 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYDSTPITFGQGTKVEIK

SEQ ID NO: 4654 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSSPDYTFGQGTKVEIK

SEQ ID NO: 4655 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSNHVVFGQGTKVEIK

SEQ ID NO: 4656 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4657 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSAWDSSRSAGVFGQGTKVEIK

SEQ ID NO: 4658 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGTFSTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVVFGQGTKVEIK

SEQ ID NO: 4659 - protein, 261 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSLYRGGGYLYYASWWMDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDNSLSDGHYVFGQGTKVEIK

SEQ ID NO: 4660 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSSNWFGIDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSADSSGAIFGQGTKVEIK

SEQ ID NO: 4661 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDTGYRGTSMLIDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGLQGPTFGQGTKVEIK

SEQ ID NO: 4662 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDTGYRGTSMLIDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGTHGRPSTFGQGTKVEIK

SEQ ID NO: 4663 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVFPYWFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYAGRHVVFGQGTKVEIK

SEQ ID NO: 4664 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVGRGRDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4665 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVIVVGSWTYAFGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLTGLSGVFGQGTKVEIK

SEQ ID NO: 4666 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVKNYRAYELHSLNFMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSDRVVFGQGTKVEIK

SEQ ID NO: 4667 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVSGDGFDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLLGPYVVFGQGTKVEIK

SEQ ID NO: 4668 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREAVSPYSNSPRADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPGVVFGQGTKVEIK

SEQ ID NO: 4669 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGGFGASDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSPPITFGQGTKVEIK

SEQ ID NO: 4670 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGGRLGFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSAPAVVFGQGTKVEIK

SEQ ID NO: 4671 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGRRGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPITFGQGTKVEIK

SEQ ID NO: 4672 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGSGYESDSSSRVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPVTFGQGTKVEIK

SEQ ID NO: 4673 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGYRCASCGAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSGVFGQGTKVEIK

SEQ ID NO: 4674 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARENLWSASGGAPSMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCTQSLQPPIVFGQGTKVEIK

SEQ ID NO: 4675 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREPYRVRLFRYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSRLSGFYVFGQGTKVEIK

SEQ ID NO: 4676 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERAGYGVWSATRMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPVTFGQGTKVEIK

SEQ ID NO: 4677 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASWDDSLNGRVFGQGTKVEIK

SEQ ID NO: 4678 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAGGVFGQGTKVEIK

SEQ ID NO: 4679 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPVTFGQGTKVEIK

SEQ ID NO: 4680 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPITFGQGTKVEIK

SEQ ID NO: 4681 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 4682 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPITFGQGTKVEIK

SEQ ID NO: 4683 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4684 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4685 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDDTGPLFGQGTKVEIK

SEQ ID NO: 4686 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGSGEYAVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 4687 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREVGRASRHYFIYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPITFGQGTKVEIK

SEQ ID NO: 4688 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWRGFPYYYYASWMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYVFGQGTKVEIK

SEQ ID NO: 4689 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFGQDTLRYAYGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNLPITFGQGTKVEIK

SEQ ID NO: 4690 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFGQDTLRYAYGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSLPITFGQGTKVEIK

SEQ ID NO: 4691 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFSGRYNGDFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSGSLHPVFGQGTKVEIK

SEQ ID NO: 4692 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFYGRVGYYYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDLPPISFGQGTKVEIK

SEQ ID NO: 4693 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGADLTYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSSPGYSFGQGTKVEIK

SEQ ID NO: 4694 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGASSSYWEPDNYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDSSLNLLYVFGQGTKVEIK

SEQ ID NO: 4695 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGAYRRVPKMFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSAPYTFGQGTKVEIK

SEQ ID NO: 4696 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGAYRRVPKMFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPHTFGQGTKVEIK

SEQ ID NO: 4697 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGDYNAFDRWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSFNHLVFGQGTKVEIK

SEQ ID NO: 4698 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGDYRVTGSTTYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGGGVFGQGTKVEIK

SEQ ID NO: 4699 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGSPSDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYDGRRTFGQGTKVEIK

SEQ ID NO: 4700 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGYSSSYYWYGMDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQALQAPITFGQGTKVEIK

SEQ ID NO: 4701 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKAWGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQFDSIPWTFGQGTKVEIK

SEQ ID NO: 4702 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKAWGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSFPWTFGQGTKVEIK

SEQ ID NO: 4703 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKRASGDAFGPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSGLSYVFGQGTKVEIK

SEQ ID NO: 4704 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSDQGWVFGQGTKVEIK

SEQ ID NO: 4705 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSPRWVFGQGTKVEIK

SEQ ID NO: 4706 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTSDFPYTFGQGTKVEIK

SEQ ID NO: 4707 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYSWTFGQGTKVEIK

SEQ ID NO: 4708 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLYRGFGVGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYSPVTFGQGTKVEIK

SEQ ID NO: 4709 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGGMSGWIGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSSLDYVFGQGTKVEIK

SEQ ID NO: 4710 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPYRRSYFSYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWGSTGIVFGQGTKVEIK

SEQ ID NO: 4711 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPYRRSYFSYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDNLPPTFGQGTKVEIK

SEQ ID NO: 4712 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQGPYLPYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPKVVFGQGTKVEIK

SEQ ID NO: 4713 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRAYRSAPAAYWMDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLNVVVFGQGTKVEIK

SEQ ID NO: 4714 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRGIYYSGGSRSLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLGAAWIFGQGTKVEIK

SEQ ID NO: 4715 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRGVIVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSWDSRGGHLVVFGQGTKVEIK

SEQ ID NO: 4716 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRGVIVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPSVVFGQGTKVEIK

SEQ ID NO: 4717 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRGVSYYGLDMWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSSLDYVFGQGTKVEIK

SEQ ID NO: 4718 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRSRMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSSDNATDITQPVFGQGTKVEIK

SEQ ID NO: 4719 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYDILTRYGYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPIFMFGQGTKVEIK

SEQ ID NO: 4720 - protein, 256 aa, Artificial Sequence; identical to SEQ ID NO: 4249
  Description of Artificial Sequence: Synthetic polypeptide

SEQ ID NO: 4721 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYSGRTGYSYWLHYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNGPVVFGQGTKVEIK

SEQ ID NO: 4722 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYYDSSPPYGYAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4723 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSAAHGYHFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSLAVVFGQGTKVEIK

SEQ ID NO: 4724 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSGKRGSGVDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSGLSYVFGQGTKVEIK

SEQ ID NO: 4725 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYASILDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPSPGFTFGQGTKVEIK

SEQ ID NO: 4726 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYRTSSSKQYLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDRLNGYVFGQGTKVEIK

SEQ ID NO: 4727 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYRTSSSKQYLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYDSSSGSLVFGQGTKVEIK

SEQ ID NO: 4728 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYRTSSSKQYLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSPVFGQGTKVEIK

SEQ ID NO: 4729 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSDAVFGQGTKVEIK

SEQ ID NO: 4730 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTYVVFGQGTKVEIK

SEQ ID NO: 4731 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPRAVFGQGTKVEIK

SEQ ID NO: 4732 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPLTFGQGTKVEIK

SEQ ID NO: 4733 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWWPPFTFGQGTKVEIK

SEQ ID NO: 4734 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4735 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPTFGQGTKVEIK

SEQ ID NO: 4736 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGSVFGQGTKVEIK

SEQ ID NO: 4737 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSSLGAVVFGQGTKVEIK

SEQ ID NO: 4738 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4739 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSAHVVFGQGTKVEIK

SEQ ID NO: 4740 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHSVVFGQGTKVEIK

SEQ ID NO: 4741 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYSYRSMYRDYFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSNTPYTFGQGTKVEIK

SEQ ID NO: 4742 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYYRTANYLYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSHLAFGQGTKVEIK

SEQ ID NO: 4743 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHADFEQQLAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQSRQLPLTFGQGTKVEIK

SEQ ID NO: 4744 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHAGLISIAALDEWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWFPHVVFGQGTKVEIK

SEQ ID NO: 4745 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHAGLISIAALDEWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSGSVVFGQGTKVEIK

SEQ ID NO: 4746 - protein, 261 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHAGLRGYSYGYNSTPPRPNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGEVVFGQGTKVEIK

SEQ ID NO: 4747 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGARRHLLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4748 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGGGTSSGPDGYDYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHNSYPLTFGQGTKVEIK

SEQ ID NO: 4749 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGGLLDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDYLVSFGQGTKVEIK

SEQ ID NO: 4750 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGKIGPNAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSYPPTFGQGTKVEIK

SEQ ID NO: 4751 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGLNWNVMDFAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSPPVTFGQGTKVEIK

SEQ ID NO: 4752 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGRELIPQFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNIGWVFGQGTKVEIK

SEQ ID NO: 4753 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGRELIPQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDGRSGPNWVFGQGTKVEIK

SEQ ID NO: 4754 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGSLAGRAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNPPVTFGQGTKVEIK

SEQ ID NO: 4755 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGVLDFAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHSSPPITFGQGTKVEIK

SEQ ID NO: 4756 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHHPSAAGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPPWTFGQGTKVEIK

SEQ ID NO: 4757 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHIRGGMNVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPITFGQGTKVEIK

SEQ ID NO: 4758 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHPRHITASKPYTGGGSQYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTNHWVFGQGTKVEIK

SEQ ID NO: 4759 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRAGYHIDGWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPLVVFGQGTKVEIK

SEQ ID NO: 4760 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRFSGSQYAFFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVVFGQGTKVEIK

SEQ ID NO: 4761 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGSTLYENYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHEYWPLTFGQGTKVEIK

SEQ ID NO: 4762 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGVAGYYAYFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVVFGQGTKVEIK

SEQ ID NO: 4763 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRRFRGSDYYSYNYPMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSALVVFGQGTKVEIK

SEQ ID NO: 4764 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRSQGYFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLRSLVVFGQGTKVEIK

SEQ ID NO: 4765 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRSQGYFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTFVVFGQGTKVEIK

SEQ ID NO: 4766 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSAPAVVFGQGTKVEIK

SEQ ID NO: 4767 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLPGYVFGQGTKVEIK

SEQ ID NO: 4768 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLRVSYVFGQGTKVEIK

SEQ ID NO: 4769 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTFVVFGQGTKVEIK

SEQ ID NO: 4770 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYVVFGQGTKVEIK

SEQ ID NO: 4771 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTSLVVFGQGTKVEIK

SEQ ID NO: 4772 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRTSAGKIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTTLVVFGQGTKVEIK

SEQ ID NO: 4773 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHSGGSLRGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDIGTYVVFGQGTKVEIK

SEQ ID NO: 4774 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHSSYYGNFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNGYVFGQGTKVEIK

SEQ ID NO: 4775 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHTGAIYFADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPPWTFGQGTKVEIK

SEQ ID NO: 4776 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHTGDSRVGVIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYVVFGQGTKVEIK

SEQ ID NO: 4777 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHVITGSYGQGPFDDWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTHVVFGQGTKVEIK

SEQ ID NO: 4778 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHWGFRYFDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAYTRANPQTLYVFGQGTKVEIK

SEQ ID NO: 4779 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHYSRTSAPYYNAVDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPLTFGQGTKVEIK

SEQ ID NO: 4780 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARINRVRTFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 4781 - protein, 257 aa, Artificial Sequence; identical to SEQ ID NO: 4254
  Description of Artificial Sequence: Synthetic polypeptide

SEQ ID NO: 4782 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLNRLFALDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSSGVVFGQGTKVEIK

SEQ ID NO: 4783 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLPAGIDAGFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCESWDDKAYWVFGQGTKVEIK

SEQ ID NO: 4784 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLPGATSKSWYYTRGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGSLVFGQGTKVEIK

SEQ ID NO: 4785 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLRGSYDYEAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPRYTFGQGTKVEIK

SEQ ID NO: 4786 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLRGSYYRNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASFDLDALWVFGQGTKVEIK

SEQ ID NO: 4787 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLTPGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSRADHWVFGQGTKVEIK

SEQ ID NO: 4788 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMGTIPRHHFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNPPVSFGQGTKVEIK

SEQ ID NO: 4789 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLNPVVFGQGTKVEIK

SEQ ID NO: 4790 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAVAVFGQGTKVEIK

SEQ ID NO: 4791 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSHLKVFGQGTKVEIK

SEQ ID NO: 4792 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTVVFGQGTKVEIK

SEQ ID NO: 4793 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMRPELDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSSTVVFGQGTKVEIK

SEQ ID NO: 4794 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMRRSSYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSLWVFGQGTKVEIK

SEQ ID NO: 4795 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMRSGGWFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPSVVFGQGTKVEIK

SEQ ID NO: 4796 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMRSGGWFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWASSGWVFGQGTKVEIK

SEQ ID NO: 4797 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMSAGGKLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSVDSSGTWVFGQGTKVEIK

SEQ ID NO: 4798 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNGRTVTKGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQVNSFPPTFGQGTKVEIK

SEQ ID NO: 4799 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNGRTVTKGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSSPPITFGQGTKVEIK

SEQ ID NO: 4800 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRGWTGSFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPITFGQGTKVEIK

SEQ ID NO: 4801 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRRLSPGGGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 4802 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRRLSPGGGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4803 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGQGDLNPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDVSSDPAWVFGQGTKVEIK

SEQ ID NO: 4804 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSGWYGVSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDQWVFGQGTKVEIK

SEQ ID NO: 4805 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNSSGYYSYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRIFGQGTKVEIK

SEQ ID NO: 4806 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPKRTVLGSTRFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDSSDNARVFGQGTKVEIK

SEQ ID NO: 4807 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRAPGYSSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRVFGQGTKVEIK

SEQ ID NO: 4808 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRAVGLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHQVFGQGTKVEIK

SEQ ID NO: 4809 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRDPGTWQFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMSYTHANTVVAFGQGTKVEIK

SEQ ID NO: 4810 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRDYSNSYYYYYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSNAMRIFGQGTKVEIK

SEQ ID NO: 4811 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRGGGHDGFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDTSIPHVVFGQGTKVEIK

SEQ ID NO: 4812 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRLVSSDSPYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCENWDSNTRVFGQGTKVEIK

SEQ ID NO: 4813 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRMSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCKQYNNLPITFGQGTKVEIK

SEQ ID NO: 4814 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRMSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNLPLTFGQGTKVEIK

SEQ ID NO: 4815 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRMSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPLTFGQGTKVEIK

SEQ ID NO: 4816 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRMSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNRFPLIFGQGTKVEIK

SEQ ID NO: 4817 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRMSGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSFPLTFGQGTKVEIK

SEQ ID NO: 4818 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRNMLRLGRAFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRVFGQGTKVEIK

SEQ ID NO: 4819 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRPTYGVPMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAVVFGQGTKVEIK

SEQ ID NO: 4820 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRRIGSFSLGPFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYGGYNNYVFGQGTKVEIK

SEQ ID NO: 4821 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSGVHYRAVGGSARLTDYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYDNWPPTFGQGTKVEIK

SEQ ID NO: 4822 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSHGHFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNFPLTFGQGTKVEIK

SEQ ID NO: 4823 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSIAAAYAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQNYSTPPWTFGQGTKVEIK

SEQ ID NO: 4824 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSKYHYYGLSNVTYGAGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNPPPVTFGQGTKVEIK

SEQ ID NO: 4825 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSPGLRGNDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGSYGAVGVFGQGTKVEIK

SEQ ID NO: 4826 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSQPRPRYNYGKFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTRVFGQGTKVEIK

SEQ ID NO: 4827 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSRLGDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNLPLTFGQGTKVEIK

SEQ ID NO: 4828 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSTFYYGSGRPYSAWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSRKTVVFGQGTKVEIK

SEQ ID NO: 4829 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTGGSSGGFALYGFGIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDLPVVFGQGTKVEIK

SEQ ID NO: 4830 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTLPRAGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 4831 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTLPRAGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPPTFGQGTKVEIK

SEQ ID NO: 4832 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTLPRAGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPPTFGQGTKVEIK

SEQ ID NO: 4833 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRGLYFGPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSSSLVVFGQGTKVEIK

SEQ ID NO: 4834 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRGLYFGPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSWDSRGGHLVVFGQGTKVEIK

SEQ ID NO: 4835 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRGLYFGPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSSDLHVVFGQGTKVEIK

SEQ ID NO: 4836 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRGSYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPSVVFGQGTKVEIK

SEQ ID NO: 4837 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTSSGSTAAPIGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSGGSPVFGQGTKVEIK

SEQ ID NO: 4838 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTVGPYGRTYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSPPITFGQGTKVEIK

SEQ ID NO: 4839 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVARGGYKTADLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLVWDSSSDHVIFGQGTKVEIK

SEQ ID NO: 4840 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVARGGYKTADLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYGNPHTFGQGTKVEIK

SEQ ID NO: 4841 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVARGGYKTADLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDNSLRGSKVFGQGTKVEIK

SEQ ID NO: 4842 - protein, 262 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVARGSYTSWVDSPYPASARYYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRVFGQGTKVEIK

SEQ ID NO: 4843 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVGWNGGNHGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRQAMRWPVAFGQGTKVEIK

SEQ ID NO: 4844 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVGWVSAPEALATTPLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQALQPPITFGQGTKVEIK

SEQ ID NO: 4845 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVGYASAGYQIDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSASPYVFGQGTKVEIK

SEQ ID NO: 4846 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVLPMKLLRGEFYYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSAGVFGQGTKVEIK

SEQ ID NO: 4847 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVPGRTRYFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSFPPTFGQGTKVEIK

SEQ ID NO: 4848 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVRSGYSSSQPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCVTWDSSLSVYVFGQGTKVEIK

SEQ ID NO: 4849 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVTSRDGYGMGVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVAFGQGTKVEIK

SEQ ID NO: 4850 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWGDSEVGNAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYPPTFGQGTKVEIK

SEQ ID NO: 4851 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAYDDSLLNPGKIFGQGTKVEIK

SEQ ID NO: 4852 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDRSSLVVFGQGTKVEIK

SEQ ID NO: 4853 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSSVVFGQGTKVEIK

SEQ ID NO: 4854 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4855 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPRTFGQGTKVEIK

SEQ ID NO: 4856 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSAPPYTFGQGTKVEIK

SEQ ID NO: 4857 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLLSGHEVFGQGTKVEIK

SEQ ID NO: 4858 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4859 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASDGGGYRSYGQSMYYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDSRSNVYVFGQGTKVEIK

SEQ ID NO: 4860 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASEGYRTDRKYWLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSNLSAGVFGQGTKVEIK

SEQ ID NO: 4861 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASEGYRTDRKYWLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSDHTVFGQGTKVEIK

SEQ ID NO: 4862 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASLLDYGETGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSRSDHWVFGQGTKVEIK

SEQ ID NO: 4863 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASSIAARRYGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 4864 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASTGVNYRRRAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSHTSRTQVVFGQGTKVEIK

SEQ ID NO: 4865 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASVPRTYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDDSSGGRVFGQGTKVEIK

SEQ ID NO: 4866 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEQPNGGWPLDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVFGQGTKVEIK

SEQ ID NO: 4867 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRDSSGYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTAEVFGQGTKVEIK

SEQ ID NO: 4868 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTGDGSLSGVVFGQGTKVEIK

SEQ ID NO: 4869 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTNTGVFGQGTKVEIK

SEQ ID NO: 4870 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGISVAGKYYYYYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRQGKHGPWKFGQGTKVEIK

SEQ ID NO: 4871 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSGWPVHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHVLFGQGTKVEIK

SEQ ID NO: 4872 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4873 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPSYSFGQGTKVEIK

SEQ ID NO: 4874 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSSPTFTFGQGTKVEIK

SEQ ID NO: 4875 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGTSPNTFGQGTKVEIK

SEQ ID NO: 4876 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNPSWTFGQGTKVEIK

SEQ ID NO: 4877 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDDSTGNYVFGQGTKVEIK

SEQ ID NO: 4878 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATPQVSGLNFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGPHVVFGQGTKVEIK

SEQ ID NO: 4879 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATPQVSGLNFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYGGSSPVVFGQGTKVEIK

SEQ ID NO: 4880 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCLDNESDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGSWDSGLQDFVFGQGTKVEIK

SEQ ID NO: 4881 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCMRHYSSGPRAVDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4882 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCRTDKRMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTSSWVFGQGTKVEIK

SEQ ID NO: 4883 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSKGHSTMQYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQAGQWPRTFGQGTKVEIK

SEQ ID NO: 4884 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSRDRPVYSDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSGDVVFGQGTKVEIK

SEQ ID NO: 4885 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSTGRARVVDWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSAHVVFGQGTKVEIK

SEQ ID NO: 4886 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRGLGWKIEPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPSVVFGQGTKVEIK

SEQ ID NO: 4887 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRGLGWKIEPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTPAVVFGQGTKVEIK

SEQ ID NO: 4888 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRGLGWKIEPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIQVVFGQGTKVEIK

SEQ ID NO: 4889 - protein, 261 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRHVSWYGDSAIYYYYYGQPYGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDTSHVVFGQGTKVEIK

SEQ ID NO: 4890 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTTARYRGSSWPSNMHYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSLTSGVFGQGTKVEIK

SEQ ID NO: 4891 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTTGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHLVVFGQGTKVEIK

SEQ ID NO: 4892 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVGDHGFVHHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSEVFGQGTKVEIK

SEQ ID NO: 4893 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVKDQRQTWSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGQYYSSQTFGQGTKVEIK

SEQ ID NO: 4894 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVKKHRPPVNGASYLGSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4895 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVNNNTGWAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSNSPPITFGQGTKVEIK

SEQ ID NO: 4896 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSSPMYTFGQGTKVEIK

SEQ ID NO: 4897 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYPWTFGQGTKVEIK

SEQ ID NO: 4898 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNTYPWTFGQGTKVEIK

SEQ ID NO: 4899 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYNYPWTFGQGTKVEIK

SEQ ID NO: 4900 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSSPPVSFGQGTKVEIK

SEQ ID NO: 4901 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSPDSSGNWVFGQGTKVEIK

SEQ ID NO: 4902 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDRNYYRSYWKGDVFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSSDSYGGNTVVFGQGTKVEIK

SEQ ID NO: 4903 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDSGGYRDQPGYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDFTPPTFGQGTKVEIK

SEQ ID NO: 4904 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDYDYSQVGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTTDRVFGQGTKVEIK

SEQ ID NO: 4905 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVREGFSGTWTAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPITFGQGTKVEIK

SEQ ID NO: 4906 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRHAFFYGYYQDDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSRLPAYVFGQGTKVEIK

SEQ ID NO: 4907 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRILFGFKGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDRSTDLVVFGQGTKVEIK

SEQ ID NO: 4908 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRKGRSVRGADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4909 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRLGTAVNTSLFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQNDTSPRTFGQGTKVEIK

SEQ ID NO: 4910 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSHLKVFGQGTKVEIK

SEQ ID NO: 4911 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRNRGWQQFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSLDSGLKSWVFGQGTKVEIK

SEQ ID NO: 4912 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRPLSWGAYYRALDDWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPLPTFGQGTKVEIK

SEQ ID NO: 4913 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRRPRWFDSAYYAPFENWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSRRNAVVFGQGTKVEIK

SEQ ID NO: 4914 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRRPRWFDSAYYAPFENWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSKWPLIFGQGTKVEIK

SEQ ID NO: 4915 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVTDSYTATAPDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQDYSPPPTFGQGTKVEIK

SEQ ID NO: 4916 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAAKNGASLGVNLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSPSGYVFGQGTKVEIK

SEQ ID NO: 4917 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAAKNGASLGVNLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDRSRRGVVFGQGTKVEIK

SEQ ID NO: 4918 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAAKNGASLGVNLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDTSTVVFGQGTKVEIK

SEQ ID NO: 4919 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAAAKNGASLGVNLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGPGIHVVFGQGTKVEIK

SEQ ID NO: 4920 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSNNDPVFGQGTKVEIK

SEQ ID NO: 4921 - protein, 243 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHQYDSSPETFGQGTKVEIK

SEQ ID NO: 4922 - protein, 243 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGTAPIAFGQGTKVEIK

SEQ ID NO: 4923 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCYSWDSTDTVVFGQGTKVEIK

SEQ ID NO: 4924 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADTAYSLPGDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 4925 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADTAYSLPGDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDNNSDLWVFGQGTKVEIK

SEQ ID NO: 4926 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAGVGRIFPYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPLTFGQGTKVEIK

SEQ ID NO: 4927 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAGAVWLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDGGRGTGVFGQGTKVEIK

SEQ ID NO: 4928 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSKVVFGQGTKVEIK

SEQ ID NO: 4929 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTTPFWVFGQGTKVEIK

SEQ ID NO: 4930 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4931 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAARDDSLNGPWVFGQGTKVEIK

SEQ ID NO: 4932 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPPYTFGQGTKVEIK

SEQ ID NO: 4933 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGSVFGQGTKVEIK

SEQ ID NO: 4934 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPTLWTFGQGTKVEIK

SEQ ID NO: 4935 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDISSWYKSGAFGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHAWDSFTASVFGQGTKVEIK

SEQ ID NO: 4936 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLGTGFMQGYWALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPLTFGQGTKVEIK

SEQ ID NO: 4937 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRFSGVFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPRTFGQGTKVEIK

SEQ ID NO: 4938 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRFSGVFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSLHRVFGQGTKVEIK

SEQ ID NO: 4939 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRLVRVLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWTNTYTRYVFGQGTKVEIK

SEQ ID NO: 4940 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNPYVFGQGTKVEIK

SEQ ID NO: 4941 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSLLVVFGQGTKVEIK

SEQ ID NO: 4942 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSKTVVFGQGTKVEIK

SEQ ID NO: 4943 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPPYTFGQGTKVEIK

SEQ ID NO: 4944 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSADSSAGFVVFGQGTKVEIK

SEQ ID NO: 4945 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTGTWTLDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPYTFGQGTKVEIK

SEQ ID NO: 4946 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDPSQKYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYNWPQTFGQGTKVEIK

SEQ ID NO: 4947 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRPGPACNRYHNYGCNVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWNSSSDHWVFGQGTKVEIK

SEQ ID NO: 4948 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRRGAGYYYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPLTFGQGTKVEIK

SEQ ID NO: 4949 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRRNWPRGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVVFGQGTKVEIK

SEQ ID NO: 4950 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRRNWPRGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYTGGSSYVFGQGTKVEIK

SEQ ID NO: 4951 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSDTYVFGQGTKVEIK

SEQ ID NO: 4952 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDNSRHPEVFGQGTKVEIK

SEQ ID NO: 4953 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTFVFGQGTKVEIK

SEQ ID NO: 4954 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 4955 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 4956 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDTHLSGPIFGQGTKVEIK

SEQ ID NO: 4957 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCVAWDDSLNGYVFGQGTKVEIK

SEQ ID NO: 4958 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4959 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTPYVVFGQGTKVEIK

SEQ ID NO: 4960 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGFLSSALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSVKEQVVFGQGTKVEIK

SEQ ID NO: 4961 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGKDYFTTGYQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSATPPTFGQGTKVEIK

SEQ ID NO: 4962 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGSTLGGSFDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 4963 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKIWRRYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 4964 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRHDALWAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSRDSTDNHQAVFGQGTKVEIK

SEQ ID NO: 4965 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSGSIWYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNTANWVFGQGTKVEIK

SEQ ID NO: 4966 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSNAATGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSAPITFGQGTKVEIK

SEQ ID NO: 4967 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVIPEKVAGLDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTNHVVFGQGTKVEIK

SEQ ID NO: 4968 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVNIGLYGVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTRRNTYVFGQGTKVEIK

SEQ ID NO: 4969 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCALEKQAPGAPGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDTLPITFGQGTKVEIK

SEQ ID NO: 4970 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCANYHWDDSSDGRIFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGSWVFGQGTKVEIK

SEQ ID NO: 4971 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGGSGSFYRLFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQHNSYPFTFGQGTKVEIK

SEQ ID NO: 4972 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARANYGFDYGSTYYSGNGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTRYTFGQGTKVEIK

SEQ ID NO: 4973 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASADDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSFHTVFGQGTKVEIK

SEQ ID NO: 4974 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAAYGDVVRPAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQHNSYPLTFGQGTKVEIK

SEQ ID NO: 4975 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDAGSGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPGFVFGQGTKVEIK

SEQ ID NO: 4976 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDATILGLDAHGHGFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSWPPSFTFGQGTKVEIK

SEQ ID NO: 4977 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 4978 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGDVMPFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCKQYDSFPITFGQGTKVEIK

SEQ ID NO: 4979 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGVAAVDDWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVVFGQGTKVEIK

SEQ ID NO: 4980 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGLKGYFGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSGLVVFGQGTKVEIK

SEQ ID NO: 4981 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGSTTGISWGYGLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCVGWDGSLSGEVFGQGTKVEIK

SEQ ID NO: 4982 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYNSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSINRDVVFGQGTKVEIK

SEQ ID NO: 4983 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWDSRSNVYVFGQGTKVEIK

SEQ ID NO: 4984 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAGVFGQGTKVEIK

SEQ ID NO: 4985 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTVVFGQGTKVEIK

SEQ ID NO: 4986 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDKGGMYGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCKQYDSFPITFGQGTKVEIK

SEQ ID NO: 4987 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLGGRFTYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHSSPPITFGQGTKVEIK

SEQ ID NO: 4988 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLPGYLTFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNSPGVTFGQGTKVEIK

SEQ ID NO: 4989 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGAWGPGGFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYTTPVTFGQGTKVEIK

SEQ ID NO: 4990 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLTGYRSRSYQWDGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASWDDSLNSGWVFGQGTKVEIK

SEQ ID NO: 4991 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLYAIGAGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 4992 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDMAGYNWIDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNLPVFGQGTKVEIK

SEQ ID NO: 4993 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPRGWGYAYGDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDSSSGRRWVFGQGTKVEIK

SEQ ID NO: 4994 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGHGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSLPRTFGQGTKVEIK

SEQ ID NO: 4995 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQGYYGGSRASEYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYNPPQTFGQGTKVEIK

SEQ ID NO: 4996 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRAGDGMDGWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLNPYVVFGQGTKVEIK

SEQ ID NO: 4997 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGRDGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQADNFPLTFGQGTKVEIK

SEQ ID NO: 4998 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGRDGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDNYPLTFGQGTKVEIK

SEQ ID NO: 4999 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGRDGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPLTFGQGTKVEIK

SEQ ID NO: 5000 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGGRDGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 5001 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGTFPLFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGSYADGRYVFGQGTKVEIK

SEQ ID NO: 5002 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTNHVVFGQGTKVEIK

SEQ ID NO: 5003 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 5004 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASYTPSRNTYVFGQGTKVEIK

SEQ ID NO: 5005 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTVVFGQGTKVEIK

SEQ ID NO: 5006 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSIWVFGQGTKVEIK

SEQ ID NO: 5007 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVVFGQGTKVEIK

SEQ ID NO: 5008 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWDSFGQVFGQGTKVEIK

SEQ ID NO: 5009 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSMSGWIFGQGTKVEIK

SEQ ID NO: 5010 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGLVFGQGTKVEIK

SEQ ID NO: 5011 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRPWMYPDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 5012 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSLTAVFGQGTKVEIK

SEQ ID NO: 5013 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRTGITGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSATVVFGQGTKVEIK

SEQ ID NO: 5014 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 5015 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPPPRTFGQGTKVEIK

SEQ ID NO: 5016 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSHYYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSFTPSSTFVVFGQGTKVEIK

SEQ ID NO: 5017 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSKGYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPITFGQGTKVEIK

SEQ ID NO: 5018 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVGVGATDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 5019 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREAGYYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSPPLTFGQGTKVEIK

SEQ ID NO: 5020 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGATGTLQGAAQYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNPPVTFGQGTKVEIK

SEQ ID NO: 5021 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREIGNVYYGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPITFGQGTKVEIK

SEQ ID NO: 5022 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSRLLSGGMFGQGTKVEIK

SEQ ID NO: 5023 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLLSAWVFGQGTKVEIK

SEQ ID NO: 5024 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTGVFGQGTKVEIK

SEQ ID NO: 5025 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTVVFGQGTKVEIK

SEQ ID NO: 5026 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSPPLTFGQGTKVEIK

SEQ ID NO: 5027 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERFQTISYTTGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHDHVVFGQGTKVEIK

SEQ ID NO: 5028 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERGVTRPFYYSGYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYASPPVSFGQGTKVEIK

SEQ ID NO: 5029 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARERYNYSRGKLGIPAMDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNLPITFGQGTKVEIK

SEQ ID NO: 5030 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREWGGSWFGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPVTFGQGTKVEIK

SEQ ID NO: 5031 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFRSSNRGFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGTHWPPTFGQGTKVEIK

SEQ ID NO: 5032 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGYRDWLKQSYYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSRLNSAVFGQGTKVEIK

SEQ ID NO: 5033 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKAWGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSTPYTFGQGTKVEIK

SEQ ID NO: 5034 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKAWGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPYTFGQGTKVEIK

SEQ ID NO: 5035 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKSLGALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 5036 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSAYVFGQGTKVEIK

SEQ ID NO: 5037 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPYRRSYFSYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQDNNLPITFGQGTKVEIK

SEQ ID NO: 5038 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPYRRSYFSYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQENSPPVTFGQGTKVEIK

SEQ ID NO: 5039 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRSVYYYQPFDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPFTFGQGTKVEIK

SEQ ID NO: 5040 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTHRVFGQGTKVEIK

SEQ ID NO: 5041 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNTYGTFGQGTKVEIK

SEQ ID NO: 5042 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYISGTTHVIFGQGTKVEIK

SEQ ID NO: 5043 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGVGARSSNLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRQGAHWPWAFGQGTKVEIK

SEQ ID NO: 5044 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHAADYSFSYPYASYMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSIVVFGQGTKVEIK

SEQ ID NO: 5045 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGDYYDSSGRVGYYGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSPPITFGQGTKVEIK

SEQ ID NO: 5046 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGIALPTAMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNPPVTFGQGTKVEIK

SEQ ID NO: 5047 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHGVSGSSYGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSIVVFGQGTKVEIK

SEQ ID NO: 5048 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHHYRSSTRSHGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDNNPITFGQGTKVEIK

SEQ ID NO: 5049 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHHYYGSGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDNPPVSFGQGTKVEIK

SEQ ID NO: 5050 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHIRGGMNVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSSPGGVFGQGTKVEIK

SEQ ID NO: 5051 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHQTDRLSSGYYYPVYMDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSSTGVFGQGTKVEIK

SEQ ID NO: 5052 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGGGYGHYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSSTAVFGQGTKVEIK

SEQ ID NO: 5053 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHVTLSSWYSIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSALLEVFGQGTKVEIK

SEQ ID NO: 5054 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHYSSSPAGDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCATWDDSLNGPVFGQGTKVEIK

SEQ ID NO: 5055 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHYSVMWDKPVYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSTTHVVFGQGTKVEIK

SEQ ID NO: 5056 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARIRYWSYQDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSRNNWVFGQGTKVEIK

SEQ ID NO: 5057 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARKFVGASSTFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPPWTFGQGTKVEIK

SEQ ID NO: 5058 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLGGRDGYFIRKGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYNNWPPTFGQGTKVEIK

SEQ ID NO: 5059 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLGSWYAGYGAMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSAAVVFGQGTKVEIK

SEQ ID NO: 5060 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLLSTSNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSFGGNNNWIFGQGTKVEIK

SEQ ID NO: 5061 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLLWSRTGHRFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNPPGYTFGQGTKVEIK

SEQ ID NO: 5062 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLRGSYYRNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSGLPYVFGQGTKVEIK

SEQ ID NO: 5063 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLTRAQQSSSAYRLRSSYYMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQLDRYPPTFGQGTKVEIK

SEQ ID NO: 5064 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLTSDHSYYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWHSGDNRWVFGQGTKVEIK

SEQ ID NO: 5065 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMDRVGSRGYTYYSTLGSYAMDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 5066 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMGGGNDSGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSPPVTFGQGTKVEIK

SEQ ID NO: 5067 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMGQHSYGKNSFAVYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQFDDLPITFGQGTKVEIK

SEQ ID NO: 5068 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMKTRKDWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLPSVVFGQGTKVEIK

SEQ ID NO: 5069 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASYSTGSTLYVFGQGTKVEIK

SEQ ID NO: 5070 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMQRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 5071 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNGRTVTKGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 5072 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNGSLGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 5073 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRGWTGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPPTFGQGTKVEIK

SEQ ID NO: 5074 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRNYSAGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPMITFGQGTKVEIK

SEQ ID NO: 5075 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRVPKYPMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQMWDSSSDHSVFGQGTKVEIK

SEQ ID NO: 5076 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNRVPKYPMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHVVFGQGTKVEIK

SEQ ID NO: 5077 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARQYISGGYSYSSRLSYGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSPPITFGQGTKVEIK

SEQ ID NO: 5078 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARQYISGGYSYSSRLSYGMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPVTFGQGTKVEIK

SEQ ID NO: 5079 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRLVSSDSPYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSSTRVFGQGTKVEIK

SEQ ID NO: 5080 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRPARSSQGRPIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 5081 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSGQYAGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPLTFGQGTKVEIK

SEQ ID NO: 5082 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSLNGGAGDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 5083 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSPRPHGGPYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPWTFGQGTKVEIK

SEQ ID NO: 5084 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGSYRPFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYDWPPTFGQGTKVEIK

SEQ ID NO: 5085 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGSYRPFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPPYTFGQGTKVEIK

SEQ ID NO: 5086 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSYVYRIGTWSYDVYLGDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSDQNYVFGQGTKVEIK

SEQ ID NO: 5087 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRYPYSMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLRSGFFGQGTKVEIK

SEQ ID NO: 5088 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTSSGSTAAPIGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEAWDDNLSRRVFGQGTKVEIK

SEQ ID NO: 5089 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVARGGYKTADLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQGDGLPRTFGQGTKVEIK

SEQ ID NO: 5090 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVASSSAGGVDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPALTFGQGTKVEIK

SEQ ID NO: 5091 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVGYGDYGGIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSALEFGQGTKVEIK

SEQ ID NO: 5092 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVNYRYLAGFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTNSFPPTFGQGTKVEIK

SEQ ID NO: 5093 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVPRDLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSISHWVFGQGTKVEIK

SEQ ID NO: 5094 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVPRDLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 5095 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVPRGGDKFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWHSGDNRWVFGQGTKVEIK

SEQ ID NO: 5096 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVRGGWSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAYSPPITFGQGTKVEIK

SEQ ID NO: 5097 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVSHGYRSMDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNGWPPWTFGQGTKVEIK

SEQ ID NO: 5098 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYRRRGDLTRRYPFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTSGTGIPVFGQGTKVEIK

SEQ ID NO: 5099 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSTPLTFGQGTKVEIK

SEQ ID NO: 5100 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASDGAKYYLSYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVVFGQGTKVEIK

SEQ ID NO: 5101 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGGLYKSGQFDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSIPRTFGQGTKVEIK

SEQ ID NO: 5102 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASHDSSGYYDWIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTYTVFGQGTKVEIK

SEQ ID NO: 5103 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASHDSSGYYDWIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQIWDSSSYVVFGQGTKVEIK

SEQ ID NO: 5104 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASKTPEWEGAPFQWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSRNNWVFGQGTKVEIK

SEQ ID NO: 5105 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASQYSSGWPPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQAIPHLRLTFGQGTKVEIK

SEQ ID NO: 5106 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASRGRGQQVGKNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSRNNWVFGQGTKVEIK

SEQ ID NO: 5107 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASWRKGYYYGRDGYPDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWHSGDNRWVFGQGTKVEIK

SEQ ID NO: 5108 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEQPNGGWPLDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLAFGQGTKVEIK

SEQ ID NO: 5109 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSGSDHWVFGQGTKVEIK

SEQ ID NO: 5110 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSYNDHVVFGQGTKVEIK

SEQ ID NO: 5111 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYASSGTWVFGQGTKVEIK

SEQ ID NO: 5112 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAYSGVYERFFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQTQTFPPTFGQGTKVEIK

SEQ ID NO: 5113 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCGKGGFWHPSYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSRSDHWVFGQGTKVEIK

SEQ ID NO: 5114 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCGRADYPFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSGDDWVFGQGTKVEIK

SEQ ID NO: 5115 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSRERPVGSYYSGLGYPKDSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRVWDSSNDHWVFGQGTKVEIK

SEQ ID NO: 5116 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSRKYYHPNYGYSSDNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSRNNWVFGQGTKVEIK

SEQ ID NO: 5117 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRDHWYSLDAWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSPPITFGQGTKVEIK

SEQ ID NO: 5118 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRENAYVSFDAVDFGMDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 5119 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRGGARYALNSWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSPPITFGQGTKVEIK

SEQ ID NO: 5120 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRGGATDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPKTFGQGTKVEIK

SEQ ID NO: 5121 - protein, 262 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRHVSWYGDSAIYYYYYGQPYGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNPMVVFGQGTKVEIK

SEQ ID NO: 5122 - protein, 262 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRHVSWYGDSAIYYYYYGQPYGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQGWDSSAHVVFGQGTKVEIK

SEQ ID NO: 5123 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRQWEAQAPFDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWNSSLSAGVFGQGTKVEIK

SEQ ID NO: 5124 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVKKVAGSYPYDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTDHVLFGQGTKVEIK

SEQ ID NO: 5125 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVNNNTGWAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 5126 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASWDDSLNGRVFGQGTKVEIK

SEQ ID NO: 5127 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSRGWVFGQGTKVEIK

SEQ ID NO: 5128 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQYYTPARVFGQGTKVEIK

SEQ ID NO: 5129 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGAHWPWAFGQGTKVEIK

SEQ ID NO: 5130 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPRTFGQGTKVEIK

SEQ ID NO: 5131 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPWTFGQGTKVEIK

SEQ ID NO: 5132 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGRSMWTFGQGTKVEIK

SEQ ID NO: 5133 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNYPWTFGQGTKVEIK

SEQ ID NO: 5134 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPQWTFGQGTKVEIK

SEQ ID NO: 5135 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPTFGQGTKVEIK

SEQ ID NO: 5136 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHWVFGQGTKVEIK

SEQ ID NO: 5137 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYATSRPKFGQGTKVEIK

SEQ ID NO: 5138 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTPYVFGQGTKVEIK

SEQ ID NO: 5139 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDSTYYGLDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTTAATLVFGQGTKVEIK

SEQ ID NO: 5140 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDSVGYRDQPGYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRTGVFGQGTKVEIK

SEQ ID NO: 5141 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVREGFSGTWTAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPPTFGQGTKVEIK

SEQ ID NO: 5142 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRHSTVPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDSPPLTFGQGTKVEIK

SEQ ID NO: 5143 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSSTDVVFGQGTKVEIK

SEQ ID NO: 5144 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRANWPLTFGQGTKVEIK

SEQ ID NO: 5145 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQVGSTPYTFGQGTKVEIK

SEQ ID NO: 5146 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLLSPLVVFGQGTKVEIK

SEQ ID NO: 5147 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSNAVFGQGTKVEIK

SEQ ID NO: 5148 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCHQSSRFPITFGQGTKVEIK

SEQ ID NO: 5149 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPPMYSFGQGTKVEIK

SEQ ID NO: 5150 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVLDSSDDHPVVFGQGTKVEIK

SEQ ID NO: 5151 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASWDDSLSGWVFGQGTKVEIK

SEQ ID NO: 5152 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGYGHSGYAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAVWDDSLSGYVFGQGTKVEIK

SEQ ID NO: 5153 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGLIDRYTRTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSFPVTFGQGTKVEIK

SEQ ID NO: 5154 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSDEYRAVGPYDYWSYAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSWGDAYYVFGQGTKVEIK

SEQ ID NO: 5155 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKVLSGTRATLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTLHGVFGQGTKVEIK

SEQ ID NO: 5156 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSADAGDNNLLFGQGTKVEIK

SEQ ID NO: 5157 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPGYRNDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQEDSRPRTFGQGTKVEIK

SEQ ID NO: 5158 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYFSTPSFGQGTKVEIK

SEQ ID NO: 5159 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDTDGYRSSFYSTAYWMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVFGQGTKVEIK

SEQ ID NO: 5160 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARFRMSSDVYYNPAYMDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTHNTTWVFGQGTKVEIK

SEQ ID NO: 5161 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGHYRRTGEGMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWTPPYTFGQGTKVEIK

SEQ ID NO: 5162 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSSSHVVFGQGTKVEIK

SEQ ID NO: 5163 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSTTQVFGQGTKVEIK

SEQ ID NO: 5164 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTSEVFGQGTKVEIK

SEQ ID NO: 5165 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSKGHSTMQYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSFADSRYIFGQGTKVEIK

SEQ ID NO: 5166 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSSGRWVFGQGTKVEIK

SEQ ID NO: 5167 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTTPYTFGQGTKVEIK

SEQ ID NO: 5168 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCADLQYDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSDGVVFGQGTKVEIK

SEQ ID NO: 5169 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAHRLWTTGWGRDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWTTGHWVFGQGTKVEIK

SEQ ID NO: 5170 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAIDALAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSHHLVVFGQGTKVEIK

SEQ ID NO: 5171 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAIDALAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSLSVVFGQGTKVEIK

SEQ ID NO: 5172 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDFRGGGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSSPRWTFGQGTKVEIK

SEQ ID NO: 5173 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDFRGGGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGWVFGQGTKVEIK

SEQ ID NO: 5174 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGKQWPKAFGQGTKVEIK

SEQ ID NO: 5175 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTTVVFGQGTKVEIK

SEQ ID NO: 5176 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGGGVYTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSIRRVFGQGTKVEIK

SEQ ID NO: 5177 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRGNWPRLFSFGQGTKVEIK

SEQ ID NO: 5178 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSGHRVVFGQGTKVEIK

SEQ ID NO: 5179 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDGHWYRGYYGSYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSNVVFGQGTKVEIK

SEQ ID NO: 5180 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSMGTWVFGQGTKVEIK

SEQ ID NO: 5181 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDHTMLGSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCKHHNSDRWTFGQGTKVEIK

SEQ ID NO: 5182 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDISSWYKSGAFGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYHNRPLWTFGQGTKVEIK

SEQ ID NO: 5183 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDISSWYKSGAFGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSAASSGSVVFGQGTKVEIK

SEQ ID NO: 5184 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLGFTRGFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSSDWVFGQGTKVEIK

SEQ ID NO: 5185 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLSSGGVFGQGTKVEIK

SEQ ID NO: 5186 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAEWADSLSGGVFGQGTKVEIK

SEQ ID NO: 5187 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQLRGYPLTFGQGTKVEIK

SEQ ID NO: 5188 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSDSTLSWSFGQGTKVEIK

SEQ ID NO: 5189 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLIYTAQDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSQGANWPWVFGQGTKVEIK

SEQ ID NO: 5190 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLRFSGVFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSGPGWVFGQGTKVEIK

SEQ ID NO: 5191 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCATGDDSRNGVVFGQGTKVEIK

SEQ ID NO: 5192 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEAWDDSSIGWVFGQGTKVEIK

SEQ ID NO: 5193 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQSIQPGWTFGQGTKVEIK

SEQ ID NO: 5194 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSPDDVFGQGTKVEIK

SEQ ID NO: 5195 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAYDSGNIVFGQGTKVEIK

SEQ ID NO: 5196 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQEWDSSIGVFGQGTKVEIK

SEQ ID NO: 5197 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQPYDSSSSGPYVFGQGTKVEIK

SEQ ID NO: 5198 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYTPTYTFGQGTKVEIK

SEQ ID NO: 5199 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNWPPYTFGQGTKVEIK

SEQ ID NO: 5200 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDNTLRGSIFGQGTKVEIK

SEQ ID NO: 5201 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSAYVFGQGTKVEIK

SEQ ID NO: 5202 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDTSRGIKVFGQGTKVEIK

SEQ ID NO: 5203 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSSTGVFGQGTKVEIK

SEQ ID NO: 5204 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHPSWVFGQGTKVEIK

SEQ ID NO: 5205 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTFARALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTEGVFGQGTKVEIK

SEQ ID NO: 5206 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLTQLYFAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGTWGWVFGQGTKVEIK

SEQ ID NO: 5207 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLVTGSLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPPAFTFGQGTKVEIK

SEQ ID NO: 5208 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDQEGYRAYGYNGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQANSTPLTFGQGTKVEIK

SEQ ID NO: 5209 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDQEGYRAYGYNGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDANNVVFGQGTKVEIK

SEQ ID NO: 5210 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDQSGTIALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSPVVFGQGTKVEIK

SEQ ID NO: 5211 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDRRGAGYYYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYGSPLTFGQGTKVEIK

SEQ ID NO: 5212 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDSAAAAADYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTNTNTLVVFGQGTKVEIK

SEQ ID NO: 5213 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDTSRYSLAFGFGDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSPYVVFGQGTKVEIK

SEQ ID NO: 5214 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLNGHYVFGQGTKVEIK

SEQ ID NO: 5215 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAEWADSLSGGVFGQGTKVEIK

SEQ ID NO: 5216 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEAWDDSLSGYVVFGQGTKVEIK

SEQ ID NO: 5217 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCESYDSSRNVVFGQGTKVEIK

SEQ ID NO: 5218 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNPAVVFGQGTKVEIK

SEQ ID NO: 5219 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNPLFTFGQGTKVEIK

SEQ ID NO: 5220 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSSLWTFGQGTKVEIK

SEQ ID NO: 5221 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWDSFGQVFGQGTKVEIK

SEQ ID NO: 5222 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYASNTHVKFGQGTKVEIK

SEQ ID NO: 5223 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDWGWYRGYGHAGAVDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTHVVFGQGTKVEIK

SEQ ID NO: 5224 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWWPAITFGQGTKVEIK

SEQ ID NO: 5225 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKETTGIGAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSHHWVFGQGTKVEIK

SEQ ID NO: 5226 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGFLSSALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYHNSVPVTFGQGTKVEIK

SEQ ID NO: 5227 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGFLSSALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPPAFNFGQGTKVEIK

SEQ ID NO: 5228 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGFLSSALDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSPSGLTFGQGTKVEIK

SEQ ID NO: 5229 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGWAYIFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSSGDGAGVFGQGTKVEIK

SEQ ID NO: 5230 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGHSSTYVIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSSAAVFGQGTKVEIK

SEQ ID NO: 5231 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGSPSGLYSLDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNNGPITFGQGTKVEIK

SEQ ID NO: 5232 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGYGPANAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSSHLVFGQGTKVEIK

SEQ ID NO: 5233 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKMDSYYAYGLDFWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSTNTLVFGQGTKVEIK

SEQ ID NO: 5234 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKQNAISLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGTHWHLAFGQGTKVEIK

SEQ ID NO: 5235 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKQNAISLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCTTWDSLNGEVFGQGTKVEIK

SEQ ID NO: 5236 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRANGHTTFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGIRVFGQGTKVEIK

SEQ ID NO: 5237 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRHDALWAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSRMGAWVFGQGTKVEIK

SEQ ID NO: 5238 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKRPPISWGPAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSLNNLWVFGQGTKVEIK

SEQ ID NO: 5239 - protein, 261 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSDEYRAVGPYDYWSYAAFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSGSYVFGQGTKVEIK

SEQ ID NO: 5240 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSIGWIGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYSSSLVAFGQGTKVEIK

SEQ ID NO: 5241 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSLWGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWESSNHLVVFGQGTKVEIK

SEQ ID NO: 5242 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKYVYYGSYLRYAMDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAASDDSLNSWVFGQGTKVEIK

SEQ ID NO: 5243 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGGSGSFYRLFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYGIPLTFGQGTKVEIK

SEQ ID NO: 5244 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASADDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSLRVFGQGTKVEIK

SEQ ID NO: 5245 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAYTGRSGLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTPFPFGQGTKVEIK

SEQ ID NO: 5246 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDARYVPDDGWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHVVFGQGTKVEIK

SEQ ID NO: 5247 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGAWETSLSGGVFGQGTKVEIK

SEQ ID NO: 5248 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDSYRGPLHGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHGVFGQGTKVEIK

SEQ ID NO: 5249 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGLGYRNLFGSHVSRWFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSSLSDVVFGQGTKVEIK

SEQ ID NO: 5250 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSRSLVVFGQGTKVEIK

SEQ ID NO: 5251 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQAKSFPLTFGQGTKVEIK

SEQ ID NO: 5252 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYCASPQTFGQGTKVEIK

SEQ ID NO: 5253 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSWPLAVTFGQGTKVEIK

SEQ ID NO: 5254 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYFYRRNVTTYYSSYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTDLVVFGQGTKVEIK

SEQ ID NO: 5255 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDHRLVPVAAQLYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPITFGQGTKVEIK

SEQ ID NO: 5256 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLHYYVAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGTHPPPTFGQGTKVEIK

SEQ ID NO: 5257 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSAGVFGQGTKVEIK

SEQ ID NO: 5258 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGHGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSTSPWVFGQGTKVEIK

SEQ ID NO: 5259 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPSGSLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWQGTNSLVVFGQGTKVEIK

SEQ ID NO: 5260 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDPTGYRLSSLYYYAGFAYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSNTQVFGQGTKVEIK

SEQ ID NO: 5261 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQTYYDSSLSYGYAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSNTRVFGQGTKVEIK

SEQ ID NO: 5262 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSSGVFGQGTKVEIK

SEQ ID NO: 5263 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRGYRGYYAGNWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGVWDSSSDHSVVFGQGTKVEIK

SEQ ID NO: 5264 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRYSPNFTFGQGTKVEIK

SEQ ID NO: 5265 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRIVPAGSDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYRASQSFGQGTKVEIK

SEQ ID NO: 5266 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRKDFRMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDNSLNTGGVFGQGTKVEIK

SEQ ID NO: 5267 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRKSTPPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYDSSSGNKVFGQGTKVEIK

SEQ ID NO: 5268 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSDVVFGQGTKVEIK

SEQ ID NO: 5269 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRRDLTLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSHDGVVFGQGTKVEIK

SEQ ID NO: 5270 - protein, 264 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRSPVYYDYYYRESDRYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQALSSSPWTFGQGTKVEIK

SEQ ID NO: 5271 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCEAWHDSGSGFVFGQGTKVEIK

SEQ ID NO: 5272 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSTPRPTFGQGTKVEIK

SEQ ID NO: 5273 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDRSSSHVVFGQGTKVEIK

SEQ ID NO: 5274 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSGGYRTSGPYFQGYAMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHPVFGQGTKVEIK

SEQ ID NO: 5275 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSTIYSTDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTNTNTLVVFGQGTKVEIK

SEQ ID NO: 5276 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREPYRVRLFRYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSDHYVFGQGTKVEIK

SEQ ID NO: 5277 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREQYYSSSGALAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSTVVFGQGTKVEIK

SEQ ID NO: 5278 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGAYRRVPKMFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPITFGQGTKVEIK

SEQ ID NO: 5279 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGDYRVTGSTTYFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSSTPRLSFGQGTKVEIK

SEQ ID NO: 5280 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGSWGYWMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNPPSFTFGQGTKVEIK

SEQ ID NO: 5281 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGKAWGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDSNSWVFGQGTKVEIK

SEQ ID NO: 5282 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSDWVFGQGTKVEIK

SEQ ID NO: 5283 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRGYRGGGTYDAFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHLYVFGQGTKVEIK

SEQ ID NO: 5284 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLRWGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQSYSPPISFGQGTKVEIK

SEQ ID NO: 5285 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLYRGFGVGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGANGPPVFGQGTKVEIK

SEQ ID NO: 5286 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLYRGFGVGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYSTTALTFGQGTKVEIK

SEQ ID NO: 5287 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGPEDMLSFDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQALDSSTGVVFGQGTKVEIK

SEQ ID NO: 5288 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRDSGSFIIDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSYSTHVFGQGTKVEIK

SEQ ID NO: 5289 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRQGFASGGVDLWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDRNSDRVFGQGTKVEIK

SEQ ID NO: 5290 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGRYRGFGVGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSNSAVVFGQGTKVEIK

SEQ ID NO: 5291 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYRTSSSKQYLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSYDSNLSGPVFGQGTKVEIK

SEQ ID NO: 5292 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGSYRTSSSKQYLDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTYDNGLRGSIFGQGTKVEIK

SEQ ID NO: 5293 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSYAGSGYVFGQGTKVEIK

SEQ ID NO: 5294 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSTGYVFGQGTKVEIK

SEQ ID NO: 5295 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYHNTPTFGQGTKVEIK

SEQ ID NO: 5296 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSFPPTFGQGTKVEIK

SEQ ID NO: 5297 - protein, 256 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTNSYRRLVYDAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSGSTRLGVFGQGTKVEIK

SEQ ID NO: 5298 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHHPSAAGAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQNYSTPWTFGQGTKVEIK

SEQ ID NO: 5299 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHPLYRNAADDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDYSRNNWVFGQGTKVEIK

SEQ ID NO: 5300 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGPAAGRFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCETWDGSLSTVVFGQGTKVEIK

SEQ ID NO: 5301 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGPAAGRFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDGSSVVFGQGTKVEIK

SEQ ID NO: 5302 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARHRGPAAGRFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSTYTFGQGTKVEIK

SEQ ID NO: 5303 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARIPNRSHGGWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSSLSANVFGQGTKVEIK

SEQ ID NO: 5304 - protein, 259 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARKEYRTFDSPYTLYRSSAYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQSADSSGPVFGQGTKVEIK

SEQ ID NO: 5305 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARKRPRPPYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHQVFGQGTKVEIK

SEQ ID NO: 5306 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLGPHYGMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQTWGTGDVVFGQGTKVEIK

SEQ ID NO: 5307 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLHLRGSIGLPPDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYKRNPRTFGQGTKVEIK

SEQ ID NO: 5308 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNAVAGTWLSSFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVLDSSSDDVVFGQGTKVEIK

SEQ ID NO: 5309 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARQYSSGWPWFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPFTFGQGTKVEIK

SEQ ID NO: 5310 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRDPGTWQFDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQARQTPVTFGQGTKVEIK

SEQ ID NO: 5311 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRDSGNMYGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDSRSRLYMFGQGTKVEIK

SEQ ID NO: 5312 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRIRANSRYSPDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSRLSTGMFGQGTKVEIK

SEQ ID NO: 5313 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRIRANSRYSPDPWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYDPPWTFGQGTKVEIK

SEQ ID NO: 5314 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRLRGRAMETDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSRHDHWVFGQGTKVEIK

SEQ ID NO: 5315 - protein, 257 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRSGSGWLHYYKDYYMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPRMITFGQGTKVEIK

SEQ ID NO: 5316 - protein, 260 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSRAGYRVDYLAWSGLFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSTYDNSQRNGGSVFGQGTKVEIK

SEQ ID NO: 5317 - protein, 258 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSYVYRIGTWSYDVYLGDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHYVFGQGTKVEIK

SEQ ID NO: 5318 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTMRGQLGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRSNWPGPFTFGQGTKVEIK

SEQ ID NO: 5319 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTRYPYSMDVWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYDSSSGFVVFGQGTKVEIK

SEQ ID NO: 5320 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVLSSRSWGSGYFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHKNSYPLIFGQGTKVEIK

SEQ ID NO: 5321 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARVSYGGLGSLDFYFQHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQAWDSSGVVFGQGTKVEIK

SEQ ID NO: 5322 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYTWIGFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQHYYTVPFTFGQGTKVEIK

SEQ ID NO: 5323 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAARDDNLDGWVFGQGTKVEIK

SEQ ID NO: 5324 - protein, 249 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYDPTGYLTDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQHYSTPRTFGQGTKVEIK

SEQ ID NO: 5325 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASEGYRTDRKYWLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCGTWDSGSSAGIFGQGTKVEIK

SEQ ID NO: 5326 - protein, 251 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASEGYRTDRKYWLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCMQGAPRPFTFGQGTKVEIK

SEQ ID NO: 5327 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRDSSGYMDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSDHVVFGQGTKVEIK

SEQ ID NO: 5328 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCAAWDDSLSGFYVFGQGTKVEIK

SEQ ID NO: 5329 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLLSYSGARHVFGQGTKVEIK

SEQ ID NO: 5330 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYENYPLTFGQGTKVEIK

SEQ ID NO: 5331 - protein, 255 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSSSHLVVFGQGTKVEIK

SEQ ID NO: 5332 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGGYRGVLAGVAFDIWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSTAVFGQGTKVEIK

SEQ ID NO: 5333 - protein, 252 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCNSRDSRGEHVIFGQGTKVEIK

SEQ ID NO: 5334 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYDDLPITFGQGTKVEIK

SEQ ID NO: 5335 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATGSYRKYAGGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYGSSPKTFGQGTKVEIK

SEQ ID NO: 5336 - protein, 244 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATLGPNDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCLQYNSTPWTFGQGTKVEIK

SEQ ID NO: 5337 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCSRKVGAFGNWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCTSYTSSSELYAFGQGTKVEIK

SEQ ID NO: 5338 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCTRDFIGRGFDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQRYSAPYTFGQGTKVEIK

SEQ ID NO: 5339 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRAFSYSWPFDHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYKNWHPTWSFGQGTKVEIK

SEQ ID NO: 5340 - protein, 253 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRDSVGYRDQPGYYLDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYNSYPSTFGQGTKVEIK

SEQ ID NO: 5341 - protein, 248 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRKNQTAGGHWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSRADHWVFGQGTKVEIK

SEQ ID NO: 5342 - protein, 246 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRRGAKGLGYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCRQGSRWPWAFGQGTKVEIK

SEQ ID NO: 5343 - protein, 254 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRRPRWFDSAYYAPFENWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCSSYTSSSTLVFGQGTKVEIK

SEQ ID NO: 5344 - protein, 250 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVSDKSGSGFLYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCASFDSSSLSAWVFGQGTKVEIK

SEQ ID NO: 5345 - protein, 245 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVTYFGRKDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQQYYTSPNTFGQGTKVEIK

SEQ ID NO: 5346 - protein, 247 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVTYFGRKDYWGQWGQGTLVTVSSGGSSRSSSSGGGGSGGGGEIVLTQSPATLSLSPGERATLSCRASQSVSSSYLAWYQQKPGQAPRLLIYGASSRATGIPARFSGSGSGTDFTLTISRLEPEDFAVYYCQVWDSSLDLWVFGQGTKVEIK

SEQ ID NO: 5347 - protein, 12 aa, Artificial Sequence
  Description of Artificial Sequence: Synthetic peptide
WTQPGNIVTNGA

SEQ ID NO: 5348 - protein, 11 aa, Artificial Sequence
  Description of Artificial Sequence: Synthetic peptide
GDLLKIQFGGA

SEQ ID NO: 5349 - protein, 9 aa, Artificial Sequence
  Description of Artificial Sequence: Synthetic peptide
SMSQSLSLA

SEQ ID NO: 5350 - protein, 13 aa, Artificial Sequence
  Description of Artificial Sequence: Synthetic peptide
SSTENFITLVDLV

SEQ ID NO: 5351 - protein, 9 aa, Artificial Sequence
  Description of Artificial Sequence: Synthetic peptide
GTHVIAAAR

SEQ ID NO: 5352 - protein, 14 aa, Artificial Sequence
  Description of Artificial Sequence: Synthetic peptide
RDEFLALLVEHLRE

SEQ ID NO: 5353 - protein, 9 aa, Artificial Sequence
  Description of Artificial Sequence: Synthetic peptide
SAEDYVRQS

SEQ ID NO: 5354 - protein, 11 aa, Artificial Sequence
  Description of Artificial Sequence: Synthetic peptide
GDLLKIQFGGA

SEQ ID NO: 5355 - protein, 9 aa, Artificial Sequence
  Description of Artificial Sequence: Synthetic peptide
SMSQSLSLA

SEQ ID NO: 5356 - protein, 13 aa, Artificial Sequence
  Description of Artificial Sequence: Synthetic peptide
SSTENFITLVDLV

SEQ ID NO: 5357 - protein, 9 aa, Artificial Sequence
  Description of Artificial Sequence: Synthetic peptide
GTHVIAAAR

SEQ ID NO: 5358 - protein, 14 aa, Artificial Sequence
  Description of Artificial Sequence: Synthetic peptide
RDEFLALLVEHLRE

SEQ ID NO: 5359 - protein, 9 aa, Artificial Sequence
  Description of Artificial Sequence: Synthetic peptide
SAEDYVRQS

SEQ ID NO: 5360 - protein, 17 aa, Artificial Sequence
  Description of Artificial Sequence: Synthetic peptide
SIYQDQEQRILKFLEEL

SEQ ID NO: 5361 - protein, 16 aa, Artificial Sequence
  Description of Artificial Sequence: Synthetic peptide
DILKVLFKEFIEISLW

SEQ ID NO: 5362 - protein, 17 aa, Artificial Sequence
  Description of Artificial Sequence: Synthetic peptide
KTMVDELFAEIVRQMNY

SEQ ID NO: 5363 - protein, 16 aa, Artificial Sequence
  Description of Artificial Sequence: Synthetic peptide
FADYNLLDLLLIHQVL

SEQ ID NO: 5364 - protein, 15 aa, Artificial Sequence
  Description of Artificial Sequence: Synthetic peptide
EDGVMARQLVYTIAD

SEQ ID NO: 5365 - protein, 16 aa, Artificial Sequence
  Description of Artificial Sequence: Synthetic peptide
TSMATPHVSGVATLVW

SEQ ID NO: 5366 - protein, 12 aa, Artificial Sequence
  Description of Artificial Sequence: Synthetic peptide
RLDRYADLIQKL

SEQ ID NO: 5367 - protein, 20 aa, Artificial Sequence
  Description of Artificial Sequence: Synthetic peptide
YENGAMLEPLSVALAGLQRA

SEQ ID NO: 5368 - protein, 12 aa, Artificial Sequence
  Description of Artificial Sequence: Synthetic peptide
EKETKEMVAFLN

SEQ ID NO: 5369 - protein, 16 aa, Artificial Sequence
  Description of Artificial Sequence: Synthetic peptide
RSEAIRDLIRDFIIRH

SEQ ID NO: 5370 - protein, 12 aa, Artificial Sequence
  Description of Artificial Sequence: Synthetic peptide
TIDILTAIRNAT

SEQ ID NO: 5371 - protein, 9 aa, Artificial Sequence
  Description of Artificial Sequence: Synthetic peptide
VDGAIHRAA

SEQ ID NO: 5372 - protein, 12 aa, Artificial Sequence
  Description of Artificial Sequence: Synthetic peptide
TIDILTAIRNAT

SEQ ID NO: 5373 - protein, 18 aa, Artificial Sequence
  Description of Artificial Sequence: Synthetic peptide
YQYLAARLAIFHLRKKAY

SEQ ID NO: 5374 - protein, 16 aa, Artificial Sequence
  Description of Artificial Sequence: Synthetic peptide
VGPAIARDIINLYNQH

SEQ ID NO: 5375 - protein, 20 aa, Artificial Sequence
  Description of Artificial Sequence: Synthetic peptide
DMIFEIFKNYLTKVAYYARQ

SEQ ID NO: 5376 - protein, 20 aa, Artificial Sequence
  Description of Artificial Sequence: Synthetic peptide
LGEWIALNVFEFFTNLNQFY

SEQ ID NO: 5377 - protein, 11 aa, Artificial Sequence
  Description of Artificial Sequence: Synthetic peptide
FAFALRKAQDT

SEQ ID NO: 5378 - protein, 18 aa, Artificial Sequence
  Description of Artificial Sequence: Synthetic peptide
GEELILKGIEAFKNWLKK

SEQ ID NO: 5379 - protein, 11 aa, Artificial Sequence
  Description of Artificial Sequence: Synthetic peptide
FAFALRKAQDT

SEQ ID NO: 5380 - protein, 16 aa, Artificial Sequence
  Description of Artificial Sequence: Synthetic peptide
HRELVHPDALNRFGKT

SEQ ID NO: 5381 - protein, 19 aa, Artificial Sequence
  Description of Artificial Sequence: Synthetic peptide
TRKALNYVPKLFEELRKTY

SEQ ID NO: 5382 - protein, 17 aa, Artificial Sequence
  Description of Artificial Sequence: Synthetic peptide
RENVDRVTEALRAALQH

SEQ ID NO: 5383 - protein, 17 aa, Artificial Sequence
  Description of Artificial Sequence: Synthetic peptide
SIYQDQEQRILKFLEEL

SEQ ID NO: 5384 - protein, 18 aa, Artificial Sequence
  Description of Artificial Sequence: Synthetic peptide
TEKYLDFMPKLFDAVRNK

SEQ ID NO: 5385 - protein, 16 aa, Artificial Sequence
  Description of Artificial Sequence: Synthetic peptide
DILKVLFKEFIEISLW

SEQ ID NO: 5386 - protein, 17 aa, Artificial Sequence
  Description of Artificial Sequence: Synthetic peptide
KTMVDELFAEIVRQMNY

SEQ ID NO: 5387 - protein, 19 aa, Artificial Sequence
  Description of Artificial Sequence: Synthetic peptide
GAVSLASMLTEIFLLQQAQ

SEQ ID NO: 5388 - protein, 19 aa, Artificial Sequence
  Description of Artificial Sequence: Synthetic peptide
PAFYLTASQQRWEEYLKKG

SEQ ID NO: 5389 - protein, 15 aa, Artificial Sequence
  Description of Artificial Sequence: Synthetic peptide
EDGVMARQLVYTIAD

SEQ ID NO: 5390 - protein, 16 aa, Artificial Sequence
  Description of Artificial Sequence: Synthetic peptide
TSMATPHVSGVATLVW

SEQ ID NO: 5391 - protein, 12 aa, Artificial Sequence
  Description of Artificial Sequence: Synthetic peptide
RLDRYADLIQKL

SEQ ID NO: 5392 - protein, 20 aa, Artificial Sequence
  Description of Artificial Sequence: Synthetic peptide
YENGAMLEPLSVALAGLQRA

SEQ ID NO: 5393 - protein, 12 aa, Artificial Sequence
  Description of Artificial Sequence: Synthetic peptide
EKETKEMVAFLN

SEQ ID NO: 5394 - protein, 16 aa, Artificial Sequence
  Description of Artificial Sequence: Synthetic peptide
RSEAIRDLIRDFIIRH

SEQ ID NO: 5395 - protein, 12 aa, Artificial Sequence
  Description of Artificial Sequence: Synthetic peptide
TIDILTAIRNAT

SEQ ID NO: 5396 - protein, 9 aa, Artificial Sequence
  Description of Artificial Sequence: Synthetic peptide
VDGAIHRAA

SEQ ID NO: 5397 - protein, 12 aa, Artificial Sequence
  Description of Artificial Sequence: Synthetic peptide
TIDILTAIRNAT

SEQ ID NO: 5398 - protein, 20 aa, Artificial Sequence
  Description of Artificial Sequence: Synthetic peptide
SLYSGSKGAVDSFVRIFSKD

SEQ ID NO: 5399 - protein, 16 aa, Artificial Sequence
  Description of Artificial Sequence: Synthetic peptide
VGPAIARDIINLYNQH

SEQ ID NO: 5400 - protein, 20 aa, Artificial Sequence
  Description of Artificial Sequence: Synthetic peptide
DMIFEIFKNYLTKVAYYARQ

SEQ ID NO: 5401 - protein, 20 aa, Artificial Sequence
  Description of Artificial Sequence: Synthetic peptide
LGEWIALNVFEFFTNLNQFY

SEQ ID NO: 5402 - protein, 11 aa, Artificial Sequence
  Description of Artificial Sequence: Synthetic peptide
FAFALRKAQDT

SEQ ID NO: 5403 - protein, 19 aa, Artificial Sequence
  Description of Artificial Sequence: Synthetic peptide
AQRRKMAQENPKMHNSEIL

SEQ ID NO: 5404 - protein, 11 aa, Artificial Sequence
  Description of Artificial Sequence: Synthetic peptide
FAFALRKAQDT

SEQ ID NO: 5405 - protein, 16 aa, Artificial Sequence
  Description of Artificial Sequence: Synthetic peptide
KLKDLSRFDASFFGVH

SEQ ID NO: 5406 - protein, 16 aa, Artificial Sequence
  Description of Artificial Sequence: Synthetic peptide
HRELVHPDALNRFGKT

SEQ ID NO: 5407 - protein, 19 aa, Artificial Sequence
  Description of Artificial Sequence: Synthetic peptide
TRKALNYVPKLFEELRKTY

SEQ ID NO: 5408 - protein, 18 aa, Artificial Sequence
  Description of Artificial Sequence: Synthetic peptide
AKGREEEARKLLRWGQQN

SEQ ID NO: 5409 - protein, 14 aa, Artificial Sequence
  Description of Artificial Sequence: Synthetic peptide
QTSLDAAQTLIRGA

SEQ ID NO: 5410 - protein, 10 aa, Artificial Sequence
  Description of Artificial Sequence: Synthetic peptide
LPLVDFIIQN

SEQ ID NO: 5411 - protein, 12 aa, Artificial Sequence
  Description of Artificial Sequence: Synthetic peptide
SSVVRGKMDGGW

SEQ ID NO: 5412 - protein, 14 aa, Artificial Sequence
  Description of Artificial Sequence: Synthetic peptide
RDTIINTLKKASKL

SEQ ID NO: 5413 - protein, 13 aa, Artificial Sequence
  Description of Artificial Sequence: Synthetic peptide
HGDLQRWQSALDA

SEQ ID NO: 5414 - protein, 10 aa, Artificial Sequence
  Description of Artificial Sequence: Synthetic peptide
DGEIKELLEK

SEQ ID NO: 5415 - protein, 14 aa, Artificial Sequence
  Description of Artificial Sequence: Synthetic peptide
AMVLESVMFAILAE

SEQ ID NO: 5416 - protein, 10 aa, Artificial Sequence
  Description of Artificial Sequence: Synthetic peptide
LRLFVRIGAM

SEQ ID NO: 5417 - protein, 11 aa, Artificial Sequence
  Description of Artificial Sequence: Synthetic peptide
PIKALMRYSEN

SEQ ID NO: 5418 - protein, 13 aa, Artificial Sequence
  Description of Artificial Sequence: Synthetic peptide
GPQVGYLSEAFEA

SEQ ID NO: 5419 - protein, 12 aa, Artificial Sequence
  Description of Artificial Sequence: Synthetic peptide
KSVIEALKHGGL

SEQ ID NO: 5420 - protein, 14 aa, Artificial Sequence
  Description of Artificial Sequence: Synthetic peptide
PDAQNALLSSLSEQ

SEQ ID NO: 5421 - protein, 11 aa, Artificial Sequence
  Description of Artificial Sequence: Synthetic peptide
TNADLLARAAS

SEQ ID NO: 5422 - protein, 10 aa, Artificial Sequence
  Description of Artificial Sequence: Synthetic peptide
NAGALAVHQL

SEQ ID NO: 5423 - protein, 12 aa, Artificial Sequence
  Description of Artificial Sequence: Synthetic peptide
IPEALRLLLQAL

SEQ ID NO: 5424 - protein, 12 aa, Artificial Sequence
  Description of Artificial Sequence: Synthetic peptide
PVGLAAAASARL

SEQ ID NO: 5425 - protein, 12 aa, Artificial Sequence
  Description of Artificial Sequence: Synthetic peptide
FAAIESVAKNIQ

SEQ ID NO: 5426 - protein, 11 aa, Artificial Sequence
  Description of Artificial Sequence: Synthetic peptide
VEEDVQLLKDL

SEQ ID NO: 5427 - protein, 13 aa, Artificial Sequence
  Description of Artificial Sequence: Synthetic peptide
HLELLLRDLEDSR

SEQ ID NO: 5428 - protein, 13 aa, Artificial Sequence
  Description of Artificial Sequence: Synthetic peptide
KIAQHTADYEERF

SEQ ID NO: 5429 - protein, 13 aa, Artificial Sequence
  Description of Artificial Sequence: Synthetic peptide
SGVAALIKVLLSL

SEQ ID NO: 5430 - protein, 15 aa, Artificial Sequence
  Description of Artificial Sequence: Synthetic peptide
TARARKFANRIHGRF

SEQ ID NO: 5431 - protein, 12 aa, Artificial Sequence
  Description of Artificial Sequence: Synthetic peptide
SFLARNRLVIAL

SEQ ID NO: 5432 - protein, 10 aa, Artificial Sequence
  Description of Artificial Sequence: Synthetic peptide
AAEAAKVALE

SEQ ID NO: 5433 - protein, 13 aa, Artificial Sequence
  Description of Artificial Sequence: Synthetic peptide
NIGASLAKRLEQT

SEQ ID NO: 5434 - protein, 14 aa, Artificial Sequence
  Description of Artificial Sequence: Synthetic peptide
EADIKERKELLRKF

SEQ ID NO: 5435 - protein, 10 aa, Artificial Sequence
  Description of Artificial Sequence: Synthetic peptide
DGEIKELLEK

SEQ ID NO: 5436 - protein, 14 aa, Artificial Sequence
  Description of Artificial Sequence: Synthetic peptide
AARMATYMDTIDYF

SEQ ID NO: 5437 - protein, 9 aa, Artificial Sequence
  Description of Artificial Sequence: Synthetic peptide
EFLLTGVLK

SEQ ID NO: 5438 - protein, 9 aa, Artificial Sequence
  Description of Artificial Sequence: Synthetic peptide
ALGTIRDII

SEQ ID NO: 5439 - protein, 10 aa, Artificial Sequence
  Description of Artificial Sequence: Synthetic peptide
PVDVITAIKA

SEQ ID NO: 5440 - protein, 12 aa, Artificial Sequence
  Description of Artificial Sequence: Synthetic peptide
WNMLRGNATQAA

SEQ ID NO: 5441 - protein, 14 aa, Artificial Sequence
  Description of Artificial Sequence: Synthetic peptide
SEPAWATALSVFAA

SEQ ID NO: 5442 - protein, 11 aa, Artificial Sequence
  Description of Artificial Sequence: Synthetic peptide
SAAAKKLINDY

SEQ ID NO: 5443 - protein, 8 aa, Artificial Sequence
  Description of Artificial Sequence: Synthetic peptide
SAEILSAS

SEQ ID NO: 5444 - protein, 13 aa, Artificial Sequence
  Description of Artificial Sequence: Synthetic peptide
DGTFLRAAELARN

SEQ ID NO: 5445 - protein, 8 aa, Artificial Sequence
  Description of Artificial Sequence: Synthetic peptide
RTELMQAS

SEQ ID NO: 5446 - protein, 11 aa, Artificial Sequence
  Description of Artificial Sequence: Synthetic peptide
QQNLILHYQAV

SEQ ID NO: 5447 - protein, 13 aa, Artificial Sequence
  Description of Artificial Sequence: Synthetic peptide
ARAYYLLGLAYDG

SEQ ID NO: 5448 - protein, 12 aa, Artificial Sequence
  Description of Artificial Sequence: Synthetic peptide
TEIAVDIARSVE

SEQ ID NO: 5449 - protein, 11 aa, Artificial Sequence
  Description of Artificial Sequence: Synthetic peptide
QQGQALAATAN

SEQ ID NO: 5450 - protein, 10 aa, Artificial Sequence
  Description of Artificial Sequence: Synthetic peptide
SQDIRALADA

SEQ ID NO: 5451 - protein, 8 aa, Artificial Sequence
  Description of Artificial Sequence: Synthetic peptide
GYSLVARK

SEQ ID NO: 5452 - protein, 10 aa, Artificial Sequence
  Description of Artificial Sequence: Synthetic peptide
WPKERDAATL

SEQ ID NO: 5453 - protein, 9 aa, Artificial Sequence
  Description of Artificial Sequence: Synthetic peptide
IPHVQRLIG

SEQ ID NO: 5454 - protein, 8 aa, Artificial Sequence
  Description of Artificial Sequence: Synthetic peptide
DLAVVKAA

SEQ ID NO: 5455 - protein, 14 aa, Artificial Sequence
  Description of Artificial Sequence: Synthetic peptide
TPGMIMASEALLRK

SEQ ID NO: 5456 - protein, 13 aa, Artificial Sequence
  Description of Artificial Sequence: Synthetic peptide
AEQFIGMSGSGYS

SEQ ID NO: 5457 - protein, 12 aa, Artificial Sequence
  Description of Artificial Sequence: Synthetic peptide
KEEIEEVVSETV

SEQ ID NO: 5458 - protein, 13 aa, Artificial Sequence
  Description of Artificial Sequence: Synthetic peptide
QEGMYQHFKAIAE

SEQ ID NO: 5459 - protein, 8 aa, Artificial Sequence
  Description of Artificial Sequence: Synthetic peptide
ASLAALAL

SEQ ID NO: 5460 - protein, 14 aa, Artificial Sequence
  Description of Artificial Sequence: Synthetic peptide
SRATLANIDRAREQ

SEQ ID NO: 5461 - protein, 10 aa, Artificial Sequence
  Description of Artificial Sequence: Synthetic peptide
NVADIIRRVW

SEQ ID NO: 5462 - protein, 9 aa, Artificial Sequence
  Description of Artificial Sequence: Synthetic peptide
ILDASLELF

SEQ ID NO: 5463 - protein, 11 aa, Artificial Sequence
  Description of Artificial Sequence: Synthetic peptide
KTQLIDVIAEK

SEQ ID NO: 5464 - protein, 10 aa, Artificial Sequence
  Description of Artificial Sequence: Synthetic peptide
IEAFFRLVKR

SEQ ID NO: 5465 - protein, 13 aa, Artificial Sequence
  Description of Artificial Sequence: Synthetic peptide
AEEKSRARRHLRT

SEQ ID NO: 5466 - protein, 10 aa, Artificial Sequence
  Description of Artificial Sequence: Synthetic peptide
RDEIFATINE

SEQ ID NO: 5467 - protein, 11 aa, Artificial Sequence
  Description of Artificial Sequence: Synthetic peptide
LASRFFAMKRS

SEQ ID NO: 5468 - protein, 13 aa, Artificial Sequence
  Description of Artificial Sequence: Synthetic peptide
QVTIDSALATQKY

SEQ ID NO: 5469 - protein, 11 aa, Artificial Sequence
  Description of Artificial Sequence: Synthetic peptide
SFVLQKIVSAI

SEQ ID NO: 5470 - protein, 11 aa, Artificial Sequence
  Description of Artificial Sequence: Synthetic peptide
DVMKKASELQK

SEQ ID NO: 5471 - protein, 13 aa, Artificial Sequence
  Description of Artificial Sequence: Synthetic peptide
WGALRYIRDLAAD

SEQ ID NO: 5472 - protein, 10 aa, Artificial Sequence
  Description of Artificial Sequence: Synthetic peptide
RKIMSLSNKL

SEQ ID NO: 5473 - protein, 9 aa, Artificial Sequence
  Description of Artificial Sequence: Synthetic peptide
QEDLAREKA

SEQ ID NO: 5474 - protein, 11 aa, Artificial Sequence
  Description of Artificial Sequence: Synthetic peptide
PLAGILFIIEE

SEQ ID NO: 5475 - protein, 14 aa, Artificial Sequence
  Description of Artificial Sequence: Synthetic peptide
AEEKFKEIAEAYDV

SEQ ID NO: 5476 - protein, 12 aa, Artificial Sequence
  Description of Artificial Sequence: Synthetic peptide
KVKQADALSSKT

SEQ ID NO: 5477 - protein, 13 aa, Artificial Sequence
  Description of Artificial Sequence: Synthetic peptide
SQGQSYGMFSALA

SEQ ID NO: 5478 - protein, 10 aa, Artificial Sequence
  Description of Artificial Sequence: Synthetic peptide
QEAAQKVVEQ

SEQ ID NO: 5479 - protein, 9 aa, Artificial Sequence
  Description of Artificial Sequence: Synthetic peptide
GQAAAATLL

SEQ ID NO: 5480 - protein, 10 aa, Artificial Sequence
  Description of Artificial Sequence: Synthetic peptide
EAILAAKAAG

SEQ ID NO: 5481 - protein, 12 aa, Artificial Sequence
  Description of Artificial Sequence: Synthetic peptide
EYARILEERATS

SEQ ID NO: 5482 - protein, 10 aa, Artificial Sequence
  Description of Artificial Sequence: Synthetic peptide
QGIIDHFQKA

SEQ ID NO: 5483 - protein, 10 aa, Artificial Sequence
  Description of Artificial Sequence: Synthetic peptide
DIALWSGLAG

SEQ ID NO: 5484 - protein, 12 aa, Artificial Sequence
  Description of Artificial Sequence: Synthetic peptide
AKAHYDGIVAFS

SEQ ID NO: 5485 - protein, 14 aa, Artificial Sequence
  Description of Artificial Sequence: Synthetic peptide
AARMATYMDTIDYF

SEQ ID NO: 5486 - protein, 14 aa, Artificial Sequence
  Description of Artificial Sequence: Synthetic peptide
VPQAMTAFAEFLNR

SEQ ID NO: 5487 - protein, 13 aa, Artificial Sequence
  Description of Artificial Sequence: Synthetic peptide
TWYRTIQDRTITD

SEQ ID NO: 5488 - protein, 10 aa, Artificial Sequence
  Description of Artificial Sequence: Synthetic peptide
QRDLLMYAVG

SEQ ID NO: 5489 - protein, 13 aa, Artificial Sequence
  Description of Artificial Sequence: Synthetic peptide
TGALGLISDWLLT

SEQ ID NO: 5490 - protein, 10 aa, Artificial Sequence
  Description of Artificial Sequence: Synthetic peptide
PVTTGFYEAI

SEQ ID NO: 5491 - protein, 12 aa, Artificial Sequence
  Description of Artificial Sequence: Synthetic peptide
LIRMFKRLEELV

SEQ ID NO: 5492 - protein, 12 aa, Artificial Sequence
  Description of Artificial Sequence: Synthetic peptide
GFFTAQTLHVAV

SEQ ID NO: 5493 - protein, 13 aa, Artificial Sequence
  Description of Artificial Sequence: Synthetic peptide
FYPAAAFIDRALS

SEQ ID NO: 5494 - protein, 18 aa, Artificial Sequence
  Description of Artificial Sequence: Synthetic peptide
SEEEARLKKSADTLWGIQ

SEQ ID NO: 5495 - protein, 12 aa, Artificial Sequence
  Description of Artificial Sequence: Synthetic peptide
TIPVLLDIAERT

SEQ ID NO: 5496 - protein, 13 aa, Artificial Sequence
  Description of Artificial Sequence: Synthetic peptide
PLLKASIKETLRL

SEQ ID NO: 5497 - protein, 14 aa, Artificial Sequence
  Description of Artificial Sequence: Synthetic peptide
RGDAEVVISEWDQV

SEQ ID NO: 5498 - protein, 11 aa, Artificial Sequence
  Description of Artificial Sequence: Synthetic peptide
IEDVIQANVKA

SEQ ID NO: 5499 - protein, 10 aa, Artificial Sequence
  Description of Artificial Sequence: Synthetic peptide
NTLEEIIFKL

SEQ ID NO: 5500 - protein, 9 aa, Artificial Sequence
  Description of Artificial Sequence: Synthetic peptide
RAATVGSLA

SEQ ID NO: 5501 - protein, 20 aa, Artificial Sequence
  Description of Artificial Sequence: Synthetic peptide
WREILERDVRNIITYFSRTY

SEQ ID NO: 5502 - protein, 8 aa, Artificial Sequence
  Description of Artificial Sequence: Synthetic peptide
PTIAFAHD

SEQ ID NO: 5503 - protein, 8 aa, Artificial Sequence
  Description of Artificial Sequence: Synthetic peptide
ANVSAAIS

SEQ ID NO: 5504 - protein, 9 aa, Artificial Sequence
  Description of Artificial Sequence: Synthetic peptide
GLEEVLYEL

SEQ ID NO: 5505 - protein, 12 aa, Artificial Sequence
  Description of Artificial Sequence: Synthetic peptide
DTLRARAVAAAR

SEQ ID NO: 5506 - protein, 11 aa, Artificial Sequence
  Description of Artificial Sequence: Synthetic peptide
PSKTLMDNYEV

SEQ ID NO: 5507 - protein, 14 aa, Artificial Sequence
  Description of Artificial Sequence: Synthetic peptide
DQEAVTAIEKFVDD

SEQ ID NO: 5508 - protein, 9 aa, Artificial Sequence
  Description of Artificial Sequence: Synthetic peptide
PEAADMVFT

SEQ ID NO: 5509 - protein, 11 aa, Artificial Sequence
  Description of Artificial Sequence: Synthetic peptide
SASQAEQFLKL

SEQ ID NO: 5510 - protein, 12 aa, Artificial Sequence
  Description of Artificial Sequence: Synthetic peptide
AFREMSDMILQA

SEQ ID NO: 5511 - protein, 9 aa, Artificial Sequence
  Description of Artificial Sequence: Synthetic peptide
TNSMRMMQQ

SEQ ID NO: 5512 - protein, 11 aa, Artificial Sequence
  Description of Artificial Sequence: Synthetic peptide
GPEGMTSFMRS

SEQ ID NO: 5513 - protein, 10 aa, Artificial Sequence
  Description of Artificial Sequence: Synthetic peptide
IERINELVAY

SEQ ID NO: 5514 - protein, 14 aa, Artificial Sequence
  Description of Artificial Sequence: Synthetic peptide
HLLDQFATAMIERT

SEQ ID NO: 5515 - protein, 8 aa, Artificial Sequence
  Description of Artificial Sequence: Synthetic peptide
VTEIAKKL

SEQ ID NO: 5516 - protein, 15 aa, Artificial Sequence
  Description of Artificial Sequence: Synthetic peptide
GAQVQALADAALEAF

SEQ ID NO: 5517 - protein, 16 aa, Artificial Sequence
  Description of Artificial Sequence: Synthetic peptide
TASLLSNVTDELRRMT

SEQ ID NO: 5518 - protein, 18 aa, Artificial Sequence
  Description of Artificial Sequence: Synthetic peptide
PLLQQIHNITSFIRQAKA

SEQ ID NO: 5519 - protein, 16 aa, Artificial Sequence
  Description of Artificial Sequence: Synthetic peptide
RHTIVNFVEQSLIVDM

SEQ ID NO: 5520 - protein, 16 aa, Artificial Sequence
  Description of Artificial Sequence: Synthetic peptide
QAHAEAWAALRHLAER

SEQ ID NO: 5521 - protein, 18 aa, Artificial Sequence
  Description of Artificial Sequence: Synthetic peptide
IVDLLQIVNQITQKLRQI

SEQ ID NO: 5522 - protein, 16 aa, Artificial Sequence
  Description of Artificial Sequence: Synthetic peptide
AADLKAVQDKLKTFVE

SEQ ID NO: 5523 - protein, 16 aa, Artificial Sequence
  Description of Artificial Sequence: Synthetic peptide
QTASHALDAALELAAD

SEQ ID NO: 5524 - protein, 18 aa, Artificial Sequence
  Description of Artificial Sequence: Synthetic peptide
QAFVDATWPQAAKAAQSL

SEQ ID NO: 5525 - protein, 17 aa, Artificial Sequence
  Description of Artificial Sequence: Synthetic peptide
RGHQKLINATVEKAREV

SEQ ID NO: 5526 - protein, 18 aa, Artificial Sequence
  Description of Artificial Sequence: Synthetic peptide
ASIFFAIKDAIRAARAQH

SEQ ID NO: 5527 - protein, 16 aa, Artificial Sequence
  Description of Artificial Sequence: Synthetic peptide
EQEHRKRVIRELNSLI

SEQ ID NO: 5528 - protein, 15 aa, Artificial Sequence
  Description of Artificial Sequence: Synthetic peptide
APARLHWLATLLMDA

SEQ ID NO: 5529 - protein, 16 aa, Artificial Sequence
  Description of Artificial Sequence: Synthetic peptide
KGFHAIQTHRLAHWLY

SEQ ID NO: 5530 - protein, 16 aa, Artificial Sequence
  Description of Artificial Sequence: Synthetic peptide
LKDLVRKAEEIGRELS

SEQ ID NO: 5531 - protein, 18 aa, Artificial Sequence
  Description of Artificial Sequence: Synthetic peptide
YQYLAARLAIFHLRKKAY

SEQ ID NO: 5532 - protein, 15 aa, Artificial Sequence
  Description of Artificial Sequence: Synthetic peptide
PVGDVKELGAIQEVF

SEQ ID NO: 5533 - protein, 18 aa, Artificial Sequence
  Description of Artificial Sequence: Synthetic peptide
TQALLRFLADHSRSKDTV

SEQ ID NO: 5534 - protein, 18 aa, Artificial Sequence
  Description of Artificial Sequence: Synthetic peptide
GRDLALLGRFYAEALVDS

SEQ ID NO: 5535 - protein, 16 aa, Artificial Sequence
  Description of Artificial Sequence: Synthetic peptide
AELRSTFFRALSDAQN

SEQ ID NO: 5536 - protein, 20 aa, Artificial Sequence
  Description of Artificial Sequence: Synthetic peptide
PREEERLKASAKARSRTLQE

SEQ ID NO: 5537 - protein, 17 aa, Artificial Sequence
  Description of Artificial Sequence: Synthetic peptide
QEQAQAGEDNLGAQAAA

SEQ ID NO: 5538 - protein, 18 aa, Artificial Sequence
  Description of Artificial Sequence: Synthetic peptide
VDELMMRLMAAMEIFTAQ

SEQ ID NO: 5539 - protein, 13 aa, Artificial Sequence
  Description of Artificial Sequence: Synthetic peptide
EMETVIPVDVMRR

SEQ ID NO: 5540 - protein, 18 aa, Artificial Sequence
  Description of Artificial Sequence: Synthetic peptide
IAEKVQYMIEWWTKSGEL

SEQ ID NO: 5541 - protein, 19 aa, Artificial Sequence
  Description of Artificial Sequence: Synthetic peptide
KEVRASAKALVQKWTNEVF

SEQ ID NO: 5542 - protein, 16 aa, Artificial Sequence
  Description of Artificial Sequence: Synthetic peptide
PAMKQIKRKIQEFHRT

SEQ ID NO: 5543 - protein, 19 aa, Artificial Sequence
  Description of Artificial Sequence: Synthetic peptide
ETTQERLRSGYEDAVDYNR

SEQ ID NO: 5544 - protein, 18 aa, Artificial Sequence
  Description of Artificial Sequence: Synthetic peptide
VQVAEEAIVNAMRVLYYR

SEQ ID NO: 5545 - protein, 16 aa, Artificial Sequence
  Description of Artificial Sequence: Synthetic peptide
YALGVRSGLQELAPHL

SEQ ID NO: 5546 - protein, 12 aa, Artificial Sequence
  Description of Artificial Sequence: Synthetic peptide
DTLRARAVAAAR

SEQ ID NO: 5547 - protein, 20 aa, Artificial Sequence
  Description of Artificial Sequence: Synthetic peptide
VEEVRELLEWYNNMNRLLKM

SEQ ID NO: 5548 - protein, 16 aa, Artificial Sequence
  Description of Artificial Sequence: Synthetic peptide
TELKHTLESEGRELVK

SEQ ID NO: 5549 - protein, 18 aa, Artificial Sequence
  Description of Artificial Sequence: Synthetic peptide
TDTYVTRIRAAVQARQRI

SEQ ID NO: 5550 - protein, 15 aa, Artificial Sequence
  Description of Artificial Sequence: Synthetic peptide
SEERAHRRMLQLQVK

SEQ ID NO: 5551 - protein, 19 aa, Artificial Sequence
  Description of Artificial Sequence: Synthetic peptide
TTTAVVVAGELLRKAEELL

SEQ ID NO: 5552 - protein, 18 aa, Artificial Sequence
  Description of Artificial Sequence: Synthetic peptide
GGPLGLMQAVLDHTIPYL

SEQ ID NO: 5553 - protein, 16 aa, Artificial Sequence
  Description of Artificial Sequence: Synthetic peptide
IFYAELARGIEDIATM

SEQ ID NO: 5554 - protein, 17 aa, Artificial Sequence
  Description of Artificial Sequence: Synthetic peptide
SEEIKKKALEFVKYINS

SEQ ID NO: 5555 - protein, 18 aa, Artificial Sequence
  Description of Artificial Sequence: Synthetic peptide
AEQLLSQARDFINQYYSS

SEQ ID NO: 5556 - protein, 15 aa, Artificial Sequence
  Description of Artificial Sequence: Synthetic peptide
ILHLVGDVVALLEAI

SEQ ID NO: 5557 - protein, 20 aa, Artificial Sequence
  Description of Artificial Sequence: Synthetic peptide
AVARAALINMVFQMGETGVA

SEQ ID NO: 5558 - protein, 14 aa, Artificial Sequence
  Description of Artificial Sequence: Synthetic peptide
AAGIAALAFSLNEL

SEQ ID NO: 5559 - protein, 17 aa, Artificial Sequence
  Description of Artificial Sequence: Synthetic peptide
FARVVETVSEAMSGLLA

SEQ ID NO: 5560 - protein, 16 aa, Artificial Sequence
  Description of Artificial Sequence: Synthetic peptide
SVNLLKSHLEELAKKQ

SEQ ID NO: 5561 - protein, 17 aa, Artificial Sequence
  Description of Artificial Sequence: Synthetic peptide
PFALKPLIAWTERERAA

SEQ ID NO: 5562 - protein, 17 aa, Artificial Sequence
  Description of Artificial Sequence: Synthetic peptide
AQAFLSEEQAFVNSILN

SEQ ID NO: 5563 - protein, 19 aa, Artificial Sequence
  Description of Artificial Sequence: Synthetic peptide
QQLRDAIEEYGNAIRQLAA

SEQ ID NO: 5564 - protein, 18 aa, Artificial Sequence
  Description of Artificial Sequence: Synthetic peptide
VPFNIASYALLTMMIAQV

SEQ ID NO: 5565 - protein, 15 aa, Artificial Sequence
  Description of Artificial Sequence: Synthetic peptide
RDQILLRLLASALQI

SEQ ID NO: 5566 - protein, 15 aa, Artificial Sequence
  Description of Artificial Sequence: Synthetic peptide
AGATILRLAKDLAEN

SEQ ID NO: 5567 - protein, 19 aa, Artificial Sequence
  Description of Artificial Sequence: Synthetic peptide
EEGLRMNISVGIQYIASWL

SEQ ID NO: 5568 - protein, 19 aa, Artificial Sequence
  Description of Artificial Sequence: Synthetic peptide
KSLIQDYDAEMAEYMKKRT

SEQ ID NO: 5569 - protein, 16 aa, Artificial Sequence
  Description of Artificial Sequence: Synthetic peptide
VGAVKAATDAGAAAAR

SEQ ID NO: 5570 - protein, 18 aa, Artificial Sequence
  Description of Artificial Sequence: Synthetic peptide
HAAELAKAEAGVAEMAAK

SEQ ID NO: 5571 - protein, 20 aa, Artificial Sequence
  Description of Artificial Sequence: Synthetic peptide
EEEKEKYAEMAREWRAAQGK

SEQ ID NO: 5572 - protein, 16 aa, Artificial Sequence
  Description of Artificial Sequence: Synthetic peptide
QAHAEAWAALRHLAER

SEQ ID NO: 5573 - protein, 19 aa, Artificial Sequence
  Description of Artificial Sequence: Synthetic peptide
QNRIDYLKAHIGQAWKAIQ

SEQ ID NO: 5574 - protein, 18 aa, Artificial Sequence
  Description of Artificial Sequence: Synthetic peptide
DEQIVDNIEAVLNVVAKK

SEQ ID NO: 5575 - protein, 19 aa, Artificial Sequence
  Description of Artificial Sequence: Synthetic peptide
ERHLDRKAELIVQVRILLK

SEQ ID NO: 5576 - protein, 16 aa, Artificial Sequence
  Description of Artificial Sequence: Synthetic peptide
HQSDVWSFGVLLWEIF

SEQ ID NO: 5577 - protein, 18 aa, Artificial Sequence
  Description of Artificial Sequence: Synthetic peptide
LPDLAARILPQAARALKE

SEQ ID NO: 5578 - protein, 16 aa, Artificial Sequence
  Description of Artificial Sequence: Synthetic peptide
PYLGAQIAKAMVKGYQ

SEQ ID NO: 5579 - protein, 18 aa, Artificial Sequence
  Description of Artificial Sequence: Synthetic peptide
EEQARKAFDRATKLEQEF

SEQ ID NO: 5580 - protein, 16 aa, Artificial Sequence
  Description of Artificial Sequence: Synthetic peptide
FVDFLVYDVLDLHRIF

SEQ ID NO: 5581 - protein, 15 aa, Artificial Sequence
  Description of Artificial Sequence: Synthetic peptide
YDKVIERILEFIREK

SEQ ID NO: 5582 - protein, 19 aa, Artificial Sequence
  Description of Artificial Sequence: Synthetic peptide
GKWWRRQLNVYWSRWLVTA

SEQ ID NO: 5583 - protein, 18 aa, Artificial Sequence
  Description of Artificial Sequence: Synthetic peptide
HLPRIERYVRLLAEHLAA

SEQ ID NO: 5584 - protein, 15 aa, Artificial Sequence
  Description of Artificial Sequence: Synthetic peptide
PEEYEKTLDELVART

SEQ ID NO: 5585 - protein, 15 aa, Artificial Sequence
  Description of Artificial Sequence: Synthetic peptide
ASSIMQTLFSQLKQF

SEQ ID NO: 5586 - protein, 18 aa, Artificial Sequence
  Description of Artificial Sequence: Synthetic peptide
LPFGFVSMFLAPWIERRL

SEQ ID NO: 5587 - protein, 18 aa, Artificial Sequence
  Description of Artificial Sequence: Synthetic peptide
LSEALKEATKEVHIRAEN

SEQ ID NO: 5588 - protein, 18 aa, Artificial Sequence
  Description of Artificial Sequence: Synthetic peptide
SEEEARLKKSADTLWGIQ

SEQ ID NO: 5589 - protein, 15 aa, Artificial Sequence
  Description of Artificial Sequence: Synthetic peptide
DSYNESIVNWLYRRH

SEQ ID NO: 5590 - protein, 18 aa, Artificial Sequence
  Description of Artificial Sequence: Synthetic peptide
IMYKGHLNLMYGLYQLVT

SEQ ID NO: 5591 - protein, 19 aa, Artificial Sequence
  Description of Artificial Sequence: Synthetic peptide
GAYSISVAEHAFALLLAHA

SEQ ID NO: 5592 - protein, 16 aa, Artificial Sequence
  Description of Artificial Sequence: Synthetic peptide
VQVTNYVEDRIIALRN

SEQ ID NO: 5593 - protein, 17 aa, Artificial Sequence
  Description of Artificial Sequence: Synthetic peptide
FLPFGYLVDQWRWGVFS

SEQ ID NO: 5594 - protein, 18 aa, Artificial Sequence
  Description of Artificial Sequence: Synthetic peptide
PASRFIRVAFLRDAMIKN

SEQ ID NO: 5595 - protein, 8 aa, Artificial Sequence
  Description of Artificial Sequence: Synthetic peptide
FQELFGPG

SEQ ID NO: 5596 - protein, 17 aa, Artificial Sequence
  Description of Artificial Sequence: Synthetic peptide
WLLEDAKGLFNATVRDA

SEQ ID NO: 5597 - protein, 16 aa, Artificial Sequence
  Description of Artificial Sequence: Synthetic peptide
GERAKQLRRFSIATLR

SEQ ID NO: 5598 - protein, 15 aa, Artificial Sequence
  Description of Artificial Sequence: Synthetic peptide
GNAIYERSFAIIRAE

SEQ ID NO: 5599 - protein, 9 aa, Artificial Sequence
  Description of Artificial Sequence: Synthetic peptide
REKLENLTE

SEQ ID NO: 5600 - protein, 9 aa, Artificial Sequence
  Description of Artificial Sequence: Synthetic peptide
DETKKARMQ

SEQ ID NO: 5601 - protein, 9 aa, Artificial Sequence
  Description of Artificial Sequence: Synthetic peptide
ENREIAQRE

SEQ ID NO: 5602 - protein, 9 aa, Artificial Sequence
  Description of Artificial Sequence: Synthetic peptide
ERIKSTLKE

SEQ ID NO: 5603 - protein, 9 aa, Artificial Sequence
  Description of Artificial Sequence: Synthetic peptide
DEQIREMKS

SEQ ID NO: 5604 - protein, 9 aa, Artificial Sequence
  Description of Artificial Sequence: Synthetic peptide
EKERLEAQT

SEQ ID NO: 5605 - protein, 9 aa, Artificial Sequence
  Description of Artificial Sequence: Synthetic peptide
RIHETNLKK

SEQ ID NO: 5606 - protein, 9 aa, Artificial Sequence
  Description of Artificial Sequence: Synthetic peptide
NEEIKKLHT

SEQ ID NO: 5607 - protein, 9 aa, Artificial Sequence
  Description of Artificial Sequence: Synthetic peptide
DQRKHHTET

SEQ ID NO: 5608 - protein, 9 aa, Artificial Sequence
  Description of Artificial Sequence: Synthetic peptide
RDTRERLHT

SEQ ID NO: 5609 - protein, 9 aa, Artificial Sequence
  Description of Artificial Sequence: Synthetic peptide
DEKRMLKTT

SEQ ID NO: 5610 - protein, 9 aa, Artificial Sequence
  Description of Artificial Sequence: Synthetic peptide
NQELKEVRD

SEQ ID NO: 5611 - protein, 9 aa, Artificial Sequence
  Description of Artificial Sequence: Synthetic peptide
ENLKNLEKH

SEQ ID NO: 5612 - protein, 9 aa, Artificial Sequence
  Description of Artificial Sequence: Synthetic peptide
TEHEKQVKE

SEQ ID NO: 5613 - protein, 10 aa, Artificial Sequence
  Description of Artificial Sequence: Synthetic peptide
SSKAKELKDR

SEQ ID NO: 5614 - protein, 10 aa, Artificial Sequence
  Description of Artificial Sequence: Synthetic peptide
NDKIEAIKSH

SEQ ID NO: 5615 - protein, 10 aa, Artificial Sequence
  Description of Artificial Sequence: Synthetic peptide
RERIREHLSS

SEQ ID NO: 5616 - protein, 10 aa, Artificial Sequence
  Description of Artificial Sequence: Synthetic peptide
RDVQDQLKEK

SEQ ID NO: 5617 - protein, 10 aa, Artificial Sequence
  Description of Artificial Sequence: Synthetic peptide
TSELREAMRK

SEQ ID NO: 5618 - protein, 10 aa, Artificial Sequence
  Description of Artificial Sequence: Synthetic peptide
QQAEDKIKEL

SEQ ID NO: 5619 - protein, 10 aa, Artificial Sequence
  Description of Artificial Sequence: Synthetic peptide
KETQKQLIDD

SEQ ID NO: 5620 - protein, 10 aa, Artificial Sequence
  Description of Artificial Sequence: Synthetic peptide
REGKDRTRQL

SEQ ID NO: 5621 - protein, 10 aa, Artificial Sequence
  Description of Artificial Sequence: Synthetic peptide
EKIRQTLEDA

SEQ ID NO: 5622 - protein, 10 aa, Artificial Sequence
  Description of Artificial Sequence: Synthetic peptide
DKIIKRANEN

SEQ ID NO: 5623 - protein, 10 aa, Artificial Sequence
  Description of Artificial Sequence: Synthetic peptide
REGAEKINQK

SEQ ID NO: 5624 - protein, 10 aa, Artificial Sequence
  Description of Artificial Sequence: Synthetic peptide
DDVVKKLDSS

SEQ ID NO: 5625 - protein, 10 aa, Artificial Sequence
  Description of Artificial Sequence: Synthetic peptide
DRTRKLMEVT

SEQ ID NO: 5626 - protein, 10 aa, Artificial Sequence
  Description of Artificial Sequence: Synthetic peptide
AEHVQQIKEH

SEQ ID NO: 5627 - protein, 10 aa, Artificial Sequence
  Description of Artificial Sequence: Synthetic peptide
RDELTQAAKK

SEQ ID NO: 5628 - protein, 10 aa, Artificial Sequence
  Description of Artificial Sequence: Synthetic peptide
AQRIKEIQDR

SEQ ID NO: 5629 - protein, 10 aa, Artificial Sequence
  Description of Artificial Sequence: Synthetic peptide
ENEIQAKAKE

SEQ ID NO: 5630 - protein, 10 aa, Artificial Sequence
  Description of Artificial Sequence: Synthetic peptide
SDDIRKLLES

SEQ ID NO: 5631 - protein, 10 aa, Artificial Sequence
  Description of Artificial Sequence: Synthetic peptide
KDSLKKIHSI

SEQ ID NO: 5632 - protein, 10 aa, Artificial Sequence
  Description of Artificial Sequence: Synthetic peptide
KKDIDDTIKS

SEQ ID NO: 5633 - protein, 10 aa, Artificial Sequence
  Description of Artificial Sequence: Synthetic peptide
KKELKELLQT

SEQ ID NO: 5634 - protein, 10 aa, Artificial Sequence
  Description of Artificial Sequence: Synthetic peptide
RDLTERAMRQ

SEQ ID NO: 5635 - protein, 10 aa, Artificial Sequence
  Description of Artificial Sequence: Synthetic peptide
IDTRLEKLKN

SEQ ID NO: 5636 - protein, 10 aa, Artificial Sequence
  Description of Artificial Sequence: Synthetic peptide
QIDEHHAVRT

SEQ ID NO: 5637 - protein, 10 aa, Artificial Sequence
  Description of Artificial Sequence: Synthetic peptide
AEETIKELKN

SEQ ID NO: 5638 - protein, 10 aa, Artificial Sequence
  Description of Artificial Sequence: Synthetic peptide
EKDTVDQVRI

SEQ ID NO: 5639 - protein, 10 aa, Artificial Sequence
  Description of Artificial Sequence: Synthetic peptide
DDETLRNVKS

SEQ ID NO: 5640 - protein, 10 aa, Artificial Sequence
  Description of Artificial Sequence: Synthetic peptide
RDELHRLLTQ

SEQ ID NO: 5641 - protein, 10 aa, Artificial Sequence
  Description of Artificial Sequence: Synthetic peptide
KEKLEATINE

SEQ ID NO: 5642 - protein, 10 aa, Artificial Sequence
  Description of Artificial Sequence: Synthetic peptide
DERVQQIKKS

SEQ ID NO: 5643 - protein, 10 aa, Artificial Sequence
  Description of Artificial Sequence: Synthetic peptide
RDQGKEMATK

SEQ ID NO: 5644 - protein, 10 aa, Artificial Sequence
  Description of Artificial Sequence: Synthetic peptide
LSTDRKMDEV

SEQ ID NO: 5645 - protein, 10 aa, Artificial Sequence
  Description of Artificial Sequence: Synthetic peptide
VEDLTSKAEK

SEQ ID NO: 5646 - protein, 10 aa, Artificial Sequence
  Description of Artificial Sequence: Synthetic peptide
EDKLRTIANE

SEQ ID NO: 5647 - protein, 10 aa, Artificial Sequence
  Description of Artificial Sequence: Synthetic peptide
REKLLDTMNR

SEQ ID NO: 5648 - protein, 10 aa, Artificial Sequence
  Description of Artificial Sequence: Synthetic peptide
NHNLERIREL

SEQ ID NO: 5649 - protein, 10 aa, Artificial Sequence
  Description of Artificial Sequence: Synthetic peptide
DKSRKLLESI

SEQ ID NO: 5650 - protein, 10 aa, Artificial Sequence
  Description of Artificial Sequence: Synthetic peptide
KNDIVELKNK

SEQ ID NO: 5651 - protein, 10 aa, Artificial Sequence
  Description of Artificial Sequence: Synthetic peptide
HTDSHLHTRQ

SEQ ID NO: 5652 - protein, 10 aa, Artificial Sequence
  Description of Artificial Sequence: Synthetic peptide
QRLRTKLETE

SEQ ID NO: 5653 - protein, 10 aa, Artificial Sequence
  Description of Artificial Sequence: Synthetic peptide
ERTRADIKSV

SEQ ID NO: 5654 - protein, 10 aa, Artificial Sequence
  Description of Artificial Sequence: Synthetic peptide
PHVTERVQKE

SEQ ID NO: 5655 - protein, 10 aa, Artificial Sequence
  Description of Artificial Sequence: Synthetic peptide
DNKLNEIGEK

SEQ ID NO: 5656 - protein, 10 aa, Artificial Sequence
  Description of Artificial Sequence: Synthetic peptide
KPKADQKLEQ

SEQ ID NO: 5657 - protein, 10 aa, Artificial Sequence
  Description of Artificial Sequence: Synthetic peptide
SAKKKDVISE

SEQ ID NO: 5658 - protein, 10 aa, Artificial Sequence
  Description of Artificial Sequence: Synthetic peptide
INEVKQHLER

SEQ ID NO: 5659 - protein, 10 aa, Artificial Sequence
  Description of Artificial Sequence: Synthetic peptide
KKEVDQAIKS

SEQ ID NO: 5660 - protein, 10 aa, Artificial Sequence
  Description of Artificial Sequence: Synthetic peptide
ATDTHRLHKE

SEQ ID NO: 5661 - protein, 10 aa, Artificial Sequence
  Description of Artificial Sequence: Synthetic peptide
HAERLKVQKN

SEQ ID NO: 5662 - protein, 10 aa, Artificial Sequence
  Description of Artificial Sequence: Synthetic peptide
TKIREKVRSD

SEQ ID NO: 5663 - protein, 10 aa, Artificial Sequence
  Description of Artificial Sequence: Synthetic peptide
ADDVKQLKSK

SEQ ID NO: 5664 - protein, 10 aa, Artificial Sequence
  Description of Artificial Sequence: Synthetic peptide
LHQVRKKLDS

SEQ ID NO: 5665 - protein, 10 aa, Artificial Sequence
  Description of Artificial Sequence: Synthetic peptide
EVEVRQARDN

SEQ ID NO: 5666 - protein, 10 aa, Artificial Sequence
  Description of Artificial Sequence: Synthetic peptide
HEKHTTALEK

SEQ ID NO: 5667 - protein, 10 aa, Artificial Sequence
  Description of Artificial Sequence: Synthetic peptide
KEDVQASLER

SEQ ID NO: 5668 - protein, 10 aa, Artificial Sequence
  Description of Artificial Sequence: Synthetic peptide
EHIKDVLKSN

SEQ ID NO: 5669 - protein, 10 aa, Artificial Sequence
  Description of Artificial Sequence: Synthetic peptide
KDELIRNNQE

SEQ ID NO: 5670 - protein, 10 aa, Artificial Sequence
  Description of Artificial Sequence: Synthetic peptide
LNTRLRKLDE

SEQ ID NO: 5671 - protein, 10 aa, Artificial Sequence
  Description of Artificial Sequence: Synthetic peptide
KDTINKIRDL

SEQ ID NO: 5672 - protein, 10 aa, Artificial Sequence
  Description of Artificial Sequence: Synthetic peptide
EMRDLVQRET

SEQ ID NO: 5673 - protein, 10 aa, Artificial Sequence
  Description of Artificial Sequence: Synthetic peptide
NREVLEQVER

SEQ ID NO: 5674 - protein, 10 aa, Artificial Sequence
  Description of Artificial Sequence: Synthetic peptide
NREVLDQVER

SEQ ID NO: 5675 - protein, 10 aa, Artificial Sequence
  Description of Artificial Sequence: Synthetic peptide
SDKAHKVLKQ

SEQ ID NO: 5676 - protein, 10 aa, Artificial Sequence
  Description of Artificial Sequence: Synthetic peptide
EAQTRELRLK

SEQ ID NO: 5677 - protein, 10 aa, Artificial Sequence
  Description of Artificial Sequence: Synthetic peptide
PETLKENLDK

SEQ ID NO: 5678 - protein, 10 aa, Artificial Sequence
  Description of Artificial Sequence: Synthetic peptide
ETTAERIKKE

SEQ ID NO: 5679 - protein, 10 aa, Artificial Sequence
  Description of Artificial Sequence: Synthetic peptide
LDDLKTRVES

SEQ ID NO: 5680 - protein, 10 aa, Artificial Sequence
  Description of Artificial Sequence: Synthetic peptide
KEHLNEIRKN

SEQ ID NO: 5681 - protein, 10 aa, Artificial Sequence
  Description of Artificial Sequence: Synthetic peptide
GQELERQLKE

SEQ ID NO: 5682 - protein, 10 aa, Artificial Sequence
  Description of Artificial Sequence: Synthetic peptide
DKVIQQIKKD

SEQ ID NO: 5683 - protein, 10 aa, Artificial Sequence
  Description of Artificial Sequence: Synthetic peptide
RDERKKSLLS

SEQ ID NO: 5684 - protein, 10 aa, Artificial Sequence
  Description of Artificial Sequence: Synthetic peptide
HETRELTRMN

SEQ ID NO: 5685 - protein, 10 aa, Artificial Sequence
  Description of Artificial Sequence: Synthetic peptide
QPTIREKVRE

SEQ ID NO: 5686 - protein, 10 aa, Artificial Sequence
  Description of Artificial Sequence: Synthetic peptide
ENTVKKLREA

SEQ ID NO: 5687 - protein, 11 aa, Artificial Sequence
  Description of Artificial Sequence: Synthetic peptide
SLMREKIRNES

SEQ ID NO: 5688 - protein, 11 aa, Artificial Sequence
  Description of Artificial Sequence: Synthetic peptide
EPMLKNFEKDT

SEQ ID NO: 5689 - protein, 11 aa, Artificial Sequence
  Description of Artificial Sequence: Synthetic peptide
EWEQLTVELRK

SEQ ID NO: 5690 - protein, 11 aa, Artificial Sequence
  Description of Artificial Sequence: Synthetic peptide
GQKDLMDRLNE

SEQ ID NO: 5691 - protein, 11 aa, Artificial Sequence
  Description of Artificial Sequence: Synthetic peptide
TKTFHEAIRDK

SEQ ID NO: 5692 - protein, 11 aa, Artificial Sequence
  Description of Artificial Sequence: Synthetic peptide
KGKITDFLSEH

SEQ ID NO: 5693 - protein, 11 aa, Artificial Sequence
  Description of Artificial Sequence: Synthetic peptide
QKRVDKIFDQM

SEQ ID NO: 5694 - protein, 11 aa, Artificial Sequence
  Description of Artificial Sequence: Synthetic peptide
INHTKDILKKF

SEQ ID NO: 5695 - protein, 11 aa, Artificial Sequence
  Description of Artificial Sequence: Synthetic peptide
DEQRKLLKEAQ

SEQ ID NO: 5696 - protein, 11 aa, Artificial Sequence
  Description of Artificial Sequence: Synthetic peptide
KSIAEDIIKKN

SEQ ID NO: 5697 - protein, 11 aa, Artificial Sequence
  Description of Artificial Sequence: Synthetic peptide
AEKIKQEVDAS

SEQ ID NO: 5698 - protein, 11 aa, Artificial Sequence
  Description of Artificial Sequence: Synthetic peptide
YKEDIKIMKQT

SEQ ID NO: 5699 - protein, 11 aa, Artificial Sequence
  Description of Artificial Sequence: Synthetic peptide
SDDVRHAVQRV

SEQ ID NO: 5700 - protein, 11 aa, Artificial Sequence
  Description of Artificial Sequence: Synthetic peptide
HSKYREEAMQN

SEQ ID NO: 5701 - protein, 11 aa, Artificial Sequence
  Description of Artificial Sequence: Synthetic peptide
SYDTGKEIIKE

SEQ ID NO: 5702 - protein, 11 aa, Artificial Sequence
  Description of Artificial Sequence: Synthetic peptide
LNNKVDELKKS

SEQ ID NO: 5703 - protein, 11 aa, Artificial Sequence
  Description of Artificial Sequence: Synthetic peptide
WEALRESIKTH

SEQ ID NO: 5704 - protein, 11 aa, Artificial Sequence
  Description of Artificial Sequence: Synthetic peptide
HSLVKAKLRET

SEQ ID NO: 5705 - protein, 11 aa, Artificial Sequence
  Description of Artificial Sequence: Synthetic peptide
ENDKEQLKAIS

SEQ ID NO: 5706 - protein, 11 aa, Artificial Sequence
  Description of Artificial Sequence: Synthetic peptide
SIGDRMKRYEN

SEQ ID NO: 5707 - protein, 11 aa, Artificial Sequence
  Description of Artificial Sequence: Synthetic peptide
RDKVNDIVDQV

SEQ ID NO: 5708 - protein, 11 aa, Artificial Sequence
  Description of Artificial Sequence: Synthetic peptide
DTVYKKLVQRE

SEQ ID NO: 5709 - protein, 11 aa, Artificial Sequence
  Description of Artificial Sequence: Synthetic peptide
SEKVVQEALDK

SEQ ID NO: 5710 - protein, 11 aa, Artificial Sequence
  Description of Artificial Sequence: Synthetic peptide
EKTLSAVKEKI

SEQ ID NO: 5711 - protein, 11 aa, Artificial Sequence
  Description of Artificial Sequence: Synthetic peptide
RDQLVGKIQER

SEQ ID NO: 5712 - protein, 11 aa, Artificial Sequence
  Description of Artificial Sequence: Synthetic peptide
HDEQTAIKNKL

SEQ ID NO: 5713 - protein, 11 aa, Artificial Sequence
  Description of Artificial Sequence: Synthetic peptide
PNDLKHVKKLS

SEQ ID NO: 5714 - protein, 11 aa, Artificial Sequence
  Description of Artificial Sequence: Synthetic peptide
DDRLNKVISEL

SEQ ID NO: 5715 - protein, 11 aa, Artificial Sequence
  Description of Artificial Sequence: Synthetic peptide
KKLLTWREETG

SEQ ID NO: 5716 - protein, 11 aa, Artificial Sequence
  Description of Artificial Sequence: Synthetic peptide
VSEKEHATRLL

SEQ ID NO: 5717 - protein, 11 aa, Artificial Sequence
  Description of Artificial Sequence: Synthetic peptide
TNRDYLAERLR

SEQ ID NO: 5718 - protein, 11 aa, Artificial Sequence
  Description of Artificial Sequence: Synthetic peptide
IHRYVNEMNKE

SEQ ID NO: 5719 - protein, 11 aa, Artificial Sequence
  Description of Artificial Sequence: Synthetic peptide
NDRKSFLLRDS

SEQ ID NO: 5720 - protein, 11 aa, Artificial Sequence
  Description of Artificial Sequence: Synthetic peptide
LDAARENARKN

SEQ ID NO: 5721 - protein, 11 aa, Artificial Sequence
  Description of Artificial Sequence: Synthetic peptide
EKIQKEAQEAL

SEQ ID NO: 5722 - protein, 11 aa, Artificial Sequence
  Description of Artificial Sequence: Synthetic peptide
DIARKEQLKSL

SEQ ID NO: 5723 - protein, 11 aa, Artificial Sequence
  Description of Artificial Sequence: Synthetic peptide
WSHTERLLKEH

SEQ ID NO: 5724 - protein, 11 aa, Artificial Sequence
  Description of Artificial Sequence: Synthetic peptide
KDSAARAKSDL

SEQ ID NO: 5725 - protein, 11 aa, Artificial Sequence
  Description of Artificial Sequence: Synthetic peptide
KETENKIIKDY

SEQ ID NO: 5726 - protein, 11 aa, Artificial Sequence
  Description of Artificial Sequence: Synthetic peptide
KDTLRETIKFM

SEQ ID NO: 5727 - protein, 11 aa, Artificial Sequence
  Description of Artificial Sequence: Synthetic peptide
FNTILKEIKER

SEQ ID NO: 5728 - protein, 11 aa, Artificial Sequence
  Description of Artificial Sequence: Synthetic peptide
SAQVDRLREEF

SEQ ID NO: 5729 - protein, 11 aa, Artificial Sequence
  Description of Artificial Sequence: Synthetic peptide
KAETKKLIDLT

SEQ ID NO: 5730 - protein, 11 aa, Artificial Sequence
  Description of Artificial Sequence: Synthetic peptide
SKERIPETVKK

SEQ ID NO: 5731 - protein, 11 aa, Artificial Sequence
  Description of Artificial Sequence: Synthetic peptide
KQERTLFKELI

SEQ ID NO: 5732 - protein, 11 aa, Artificial Sequence
  Description of Artificial Sequence: Synthetic peptide
EKSKTAFKEAQ

SEQ ID NO: 5733 - protein, 11 aa, Artificial Sequence
  Description of Artificial Sequence: Synthetic peptide
LSEALKEATKE

SEQ ID NO: 5734 - protein, 11 aa, Artificial Sequence
  Description of Artificial Sequence: Synthetic peptide
ETKIFEAVKQE

SEQ ID NO: 5735 - protein, 11 aa, Artificial Sequence
  Description of Artificial Sequence: Synthetic peptide
EEQVTKLLHRK

SEQ ID NO: 5736 - protein, 11 aa, Artificial Sequence
  Description of Artificial Sequence: Synthetic peptide
RTDLKDYITKN

SEQ ID NO: 5737 - protein, 11 aa, Artificial Sequence
  Description of Artificial Sequence: Synthetic peptide
TLLEKTLKERL

SEQ ID NO: 5738 - protein, 11 aa, Artificial Sequence
  Description of Artificial Sequence: Synthetic peptide
KEALASRFKET

SEQ ID NO: 5739 - protein, 11 aa, Artificial Sequence
  Description of Artificial Sequence: Synthetic peptide
ENQSKKLKELM

SEQ ID NO: 5740 - protein, 11 aa, Artificial Sequence
  Description of Artificial Sequence: Synthetic peptide
LEKVKNWQKDA

SEQ ID NO: 5741 - protein, 11 aa, Artificial Sequence
  Description of Artificial Sequence: Synthetic peptide
AKKQINDYVEK

SEQ ID NO: 5742 - protein, 11 aa, Artificial Sequence
  Description of Artificial Sequence: Synthetic peptide
SSLKDIDIARE

SEQ ID NO: 5743 - protein, 11 aa, Artificial Sequence
  Description of Artificial Sequence: Synthetic peptide
EEARTRKFQAM

SEQ ID NO: 5744 - protein, 11 aa, Artificial Sequence
  Description of Artificial Sequence: Synthetic peptide
GEDTWEAIKQK

SEQ ID NO: 5745 - protein, 11 aa, Artificial Sequence
  Description of Artificial Sequence: Synthetic peptide
HHTRVRVYQEI

SEQ ID NO: 5746 - protein, 11 aa, Artificial Sequence
  Description of Artificial Sequence: Synthetic peptide
DARKKDLKSIQ

SEQ ID NO: 5747 - protein, 11 aa, Artificial Sequence
  Description of Artificial Sequence: Synthetic peptide
DEKAEHLQKTY

SEQ ID NO: 5748 - protein, 11 aa, Artificial Sequence
  Description of Artificial Sequence: Synthetic peptide
KEFQKESLSMD

SEQ ID NO: 5749 - protein, 11 aa, Artificial Sequence
  Description of Artificial Sequence: Synthetic peptide
PKEAEQFVKES

SEQ ID NO: 5750 - protein, 11 aa, Artificial Sequence
  Description of Artificial Sequence: Synthetic peptide
REEFTKKVRTN

SEQ ID NO: 5751 - protein, 11 aa, Artificial Sequence
  Description of Artificial Sequence: Synthetic peptide
ERANELVESYR

SEQ ID NO: 5752 - protein, 11 aa, Artificial Sequence
  Description of Artificial Sequence: Synthetic peptide
ASDVEERVQKS

SEQ ID NO: 5753 - protein, 11 aa, Artificial Sequence
  Description of Artificial Sequence: Synthetic peptide
RENALLELSKK

SEQ ID NO: 5754 - protein, 11 aa, Artificial Sequence
  Description of Artificial Sequence: Synthetic peptide
VEEAKNRADQW

SEQ ID NO: 5755 - protein, 11 aa, Artificial Sequence
  Description of Artificial Sequence: Synthetic peptide
LEEWVEKAKSS

SEQ ID NO: 5756 - protein, 11 aa, Artificial Sequence
  Description of Artificial Sequence: Synthetic peptide
MTQKVEELKET

SEQ ID NO: 5757 - protein, 11 aa, Artificial Sequence
  Description of Artificial Sequence: Synthetic peptide
ENSKKTQELVE

SEQ ID NO: 5758 - protein, 11 aa, Artificial Sequence
  Description of Artificial Sequence: Synthetic peptide
ETTAERIKKEI

SEQ ID NO: 5759 - protein, 11 aa, Artificial Sequence
  Description of Artificial Sequence: Synthetic peptide
TDQMREAVKRV

SEQ ID NO: 5760 - protein, 11 aa, Artificial Sequence
  Description of Artificial Sequence: Synthetic peptide
NHDVKLLRKLN

SEQ ID NO: 5761 - protein, 11 aa, Artificial Sequence
  Description of Artificial Sequence: Synthetic peptide
FATKLREKLES

SEQ ID NO: 5762 - protein, 11 aa, Artificial Sequence
  Description of Artificial Sequence: Synthetic peptide
EKGKRIRENYS

SEQ ID NO: 5763 - protein, 11 aa, Artificial Sequence
  Description of Artificial Sequence: Synthetic peptide
HDQAVRTYQEH

SEQ ID NO: 5764 - protein, 11 aa, Artificial Sequence
  Description of Artificial Sequence: Synthetic peptide
KENLLDFIKHN

SEQ ID NO: 5765 - protein, 11 aa, Artificial Sequence
  Description of Artificial Sequence: Synthetic peptide
MESTFERIKEL

SEQ ID NO: 5766 - protein, 11 aa, Artificial Sequence
  Description of Artificial Sequence: Synthetic peptide
KDQARQALDKL

SEQ ID NO: 5767 - protein, 11 aa, Artificial Sequence
  Description of Artificial Sequence: Synthetic peptide
SKDMESHVFLK

SEQ ID NO: 5768 - protein, 11 aa, Artificial Sequence
  Description of Artificial Sequence: Synthetic peptide
VKDAMQHLDRQ

SEQ ID NO: 5769 - protein, 11 aa, Artificial Sequence
  Description of Artificial Sequence: Synthetic peptide
VDRLKDKVNNT

SEQ ID NO: 5770 - protein, 11 aa, Artificial Sequence
  Description of Artificial Sequence: Synthetic peptide
NRDVERIAELS

SEQ ID NO: 5771 - protein, 11 aa, Artificial Sequence
  Description of Artificial Sequence: Synthetic peptide
DQVWDEIVKKN

SEQ ID NO: 5772 - protein, 11 aa, Artificial Sequence
  Description of Artificial Sequence: Synthetic peptide
HDALIQLHEQR

SEQ ID NO: 5773 - protein, 11 aa, Artificial Sequence
  Description of Artificial Sequence: Synthetic peptide
KEKLEATINEL

SEQ ID NO: 5774 - protein, 11 aa, Artificial Sequence
  Description of Artificial Sequence: Synthetic peptide
QAELDRLRVET

SEQ ID NO: 5775 - protein, 11 aa, Artificial Sequence
  Description of Artificial Sequence: Synthetic peptide
HAISTEKIKAK

SEQ ID NO: 5776 - protein, 11 aa, Artificial Sequence
  Description of Artificial Sequence: Synthetic peptide
QVKAKHLKDSM

SEQ ID NO: 5777 - protein, 11 aa, Artificial Sequence
  Description of Artificial Sequence: Synthetic peptide
HSKLAESVEKA

SEQ ID NO: 5778 - protein, 11 aa, Artificial Sequence
  Description of Artificial Sequence: Synthetic peptide
SYDRLMKTIKE

SEQ ID NO: 5779 - protein, 11 aa, Artificial Sequence
  Description of Artificial Sequence: Synthetic peptide
ETDHFDIKNLK

SEQ ID NO: 5780 - protein, 11 aa, Artificial Sequence
  Description of Artificial Sequence: Synthetic peptide
NGKAADRIHQD

SEQ ID NO: 5781 - protein, 11 aa, Artificial Sequence
  Description of Artificial Sequence: Synthetic peptide
SDDIRKLLESQ

SEQ ID NO: 5782 - protein, 11 aa, Artificial Sequence
  Description of Artificial Sequence: Synthetic peptide
KTQMQEKAKEI

SEQ ID NO: 5783 - protein, 11 aa, Artificial Sequence
  Description of Artificial Sequence: Synthetic peptide
ADTIKKLTDKI

SEQ ID NO: 5784 - protein, 11 aa, Artificial Sequence
  Description of Artificial Sequence: Synthetic peptide
PDKTVKKVQDK

SEQ ID NO: 5785 - protein, 11 aa, Artificial Sequence
  Description of Artificial Sequence: Synthetic peptide
TLKQEYERDRD

SEQ ID NO: 5786 - protein, 11 aa, Artificial Sequence
  Description of Artificial Sequence: Synthetic peptide
RQKELEQRKLT

SEQ ID NO: 5787 - protein, 11 aa, Artificial Sequence
  Description of Artificial Sequence: Synthetic peptide
QAELKELLQKE

SEQ ID NO: 5788 - protein, 11 aa, Artificial Sequence
  Description of Artificial Sequence: Synthetic peptide
SDKIKKFLTES

SEQ ID NO: 5789 - protein, 11 aa, Artificial Sequence
  Description of Artificial Sequence: Synthetic peptide
KSDMEKLAKAT

SEQ ID NO: 5790 - protein, 11 aa, Artificial Sequence
  Description of Artificial Sequence: Synthetic peptide
IKKLKENIAQH

SEQ ID NO: 5791 - protein, 11 aa, Artificial Sequence
  Description of Artificial Sequence: Synthetic peptide
SSHLKAHLRTH

SEQ ID NO: 5792 - protein, 11 aa, Artificial Sequence
  Description of Artificial Sequence: Synthetic peptide
ELKSKLLDFRN

SEQ ID NO: 5793 - protein, 11 aa, Artificial Sequence
  Description of Artificial Sequence: Synthetic peptide
VDFLTDQRLRE

SEQ ID NO: 5794 - protein, 11 aa, Artificial Sequence
  Description of Artificial Sequence: Synthetic peptide
SERGRQLADHL

SEQ ID NO: 5795 - protein, 11 aa, Artificial Sequence
  Description of Artificial Sequence: Synthetic peptide
RISDKFTELKE

SEQ ID NO: 5796 - protein, 11 aa, Artificial Sequence
  Description of Artificial Sequence: Synthetic peptide
DRLIKSHIKTN

SEQ ID NO: 5797 - protein, 11 aa, Artificial Sequence
  Description of Artificial Sequence: Synthetic peptide
LKNWVRELRQH

SEQ ID NO: 5798 - protein, 11 aa, Artificial Sequence
  Description of Artificial Sequence: Synthetic peptide
KAHLAQHQKTH

SEQ ID NO: 5799 - protein, 11 aa, Artificial Sequence
  Description of Artificial Sequence: Synthetic peptide
DKADLDGQLTK

SEQ ID NO: 5800 - protein, 11 aa, Artificial Sequence
  Description of Artificial Sequence: Synthetic peptide
TDDKEKLLKTL

SEQ ID NO: 5801 - protein, 11 aa, Artificial Sequence
  Description of Artificial Sequence: Synthetic peptide
KSELKELINNE

SEQ ID NO: 5802 - protein, 11 aa, Artificial Sequence
  Description of Artificial Sequence: Synthetic peptide
IHRYIQEMNRK

SEQ ID NO: 5803 - protein, 11 aa, Artificial Sequence
  Description of Artificial Sequence: Synthetic peptide
PEQVERLTKEF

SEQ ID NO: 5804 - protein, 11 aa, Artificial Sequence
  Description of Artificial Sequence: Synthetic peptide
SSHLKAHTRTH

SEQ ID NO: 5805 - protein, 11 aa, Artificial Sequence
  Description of Artificial Sequence: Synthetic peptide
DEQVLEKVARQ

SEQ ID NO: 5806 - protein, 11 aa, Artificial Sequence
  Description of Artificial Sequence: Synthetic peptide
KSELKELLTRE

SEQ ID NO: 5807 - protein, 11 aa, Artificial Sequence
  Description of Artificial Sequence: Synthetic peptide
KNQKDVLKELL

SEQ ID NO: 5808 - protein, 11 aa, Artificial Sequence
  Description of Artificial Sequence: Synthetic peptide
GLEDKVSKQLE

SEQ ID NO: 5809 - protein, 11 aa, Artificial Sequence
  Description of Artificial Sequence: Synthetic peptide
ERKEMATILSK

SEQ ID NO: 5810 - protein, 11 aa, Artificial Sequence
  Description of Artificial Sequence: Synthetic peptide
SEDRLVNEKFR

SEQ ID NO: 5811 - protein, 11 aa, Artificial Sequence
  Description of Artificial Sequence: Synthetic peptide
REQYEKMQKDG

SEQ ID NO: 5812 - protein, 11 aa, Artificial Sequence
  Description of Artificial Sequence: Synthetic peptide
EKKLITDALNK

SEQ ID NO: 5813 - protein, 11 aa, Artificial Sequence
  Description of Artificial Sequence: Synthetic peptide
KTEINEALKKI

SEQ ID NO: 5814 - protein, 11 aa, Artificial Sequence
  Description of Artificial Sequence: Synthetic peptide
RQLEWGLERTR

SEQ ID NO: 5815 - protein, 11 aa, Artificial Sequence
  Description of Artificial Sequence: Synthetic peptide
TAHRLQLHDEH

SEQ ID NO: 5816 - protein, 11 aa, Artificial Sequence
  Description of Artificial Sequence: Synthetic peptide
DKDLTQLKKEA

SEQ ID NO: 5817 - protein, 11 aa, Artificial Sequence
  Description of Artificial Sequence: Synthetic peptide
DFHHETRVTLT

SEQ ID NO: 5818 - protein, 11 aa, Artificial Sequence
  Description of Artificial Sequence: Synthetic peptide
DDAAKKLQRYT

SEQ ID NO: 5819 - protein, 11 aa, Artificial Sequence
  Description of Artificial Sequence: Synthetic peptide
ASLVKELRERT

SEQ ID NO: 5820 - protein, 11 aa, Artificial Sequence
  Description of Artificial Sequence: Synthetic peptide
TTIHRIKQKEF

SEQ ID NO: 5821 - protein, 11 aa, Artificial Sequence
  Description of Artificial Sequence: Synthetic peptide
LPRVMKDSKNE

SEQ ID NO: 5822 - protein, 11 aa, Artificial Sequence
  Description of Artificial Sequence: Synthetic peptide
AHDRILKTIKT

SEQ ID NO: 5823 - protein, 11 aa, Artificial Sequence
  Description of Artificial Sequence: Synthetic peptide
LEDVSNFLKER

SEQ ID NO: 5824 - protein, 11 aa, Artificial Sequence
  Description of Artificial Sequence: Synthetic peptide
EDKLRTIANEN

SEQ ID NO: 5825 - protein, 11 aa, Artificial Sequence
  Description of Artificial Sequence: Synthetic peptide
VDKIRNQYRED

SEQ ID NO: 5826 - protein, 11 aa, Artificial Sequence
  Description of Artificial Sequence: Synthetic peptide
EKELSLLRNRK

SEQ ID NO: 5827 - protein, 11 aa, Artificial Sequence
  Description of Artificial Sequence: Synthetic peptide
NEKYQILARDH

SEQ ID NO: 5828 - protein, 11 aa, Artificial Sequence
  Description of Artificial Sequence: Synthetic peptide
ANDLLSKVKKD

SEQ ID NO: 5829 - protein, 11 aa, Artificial Sequence
  Description of Artificial Sequence: Synthetic peptide
HSIIKGIKDRT

SEQ ID NO: 5830 - protein, 11 aa, Artificial Sequence
  Description of Artificial Sequence: Synthetic peptide
PREQLMESIRK

SEQ ID NO: 5831 - protein, 11 aa, Artificial Sequence
  Description of Artificial Sequence: Synthetic peptide
ETQAKELAAHK

SEQ ID NO: 5832 - protein, 11 aa, Artificial Sequence
  Description of Artificial Sequence: Synthetic peptide
REKLLDTMNRL

SEQ ID NO: 5833 - protein, 11 aa, Artificial Sequence
  Description of Artificial Sequence: Synthetic peptide
DDFQQKIEKIK

SEQ ID NO: 5834 - protein, 11 aa, Artificial Sequence
  Description of Artificial Sequence: Synthetic peptide
RVHTSELKLRA

SEQ ID NO: 5835 - protein, 11 aa, Artificial Sequence
  Description of Artificial Sequence: Synthetic peptide
ETKLRETITRH

SEQ ID NO: 5836 - protein, 11 aa, Artificial Sequence
  Description of Artificial Sequence: Synthetic peptide
ISDLHQTLKKE

SEQ ID NO: 5837 - protein, 11 aa, Artificial Sequence
  Description of Artificial Sequence: Synthetic peptide
QHERLGTLVRE

SEQ ID NO: 5838 - protein, 11 aa, Artificial Sequence
  Description of Artificial Sequence: Synthetic peptide
DEFDAQMTKAK

SEQ ID NO: 5839 - protein, 11 aa, Artificial Sequence
  Description of Artificial Sequence: Synthetic peptide
VHEKWQKAIQK

SEQ ID NO: 5840 - protein, 11 aa, Artificial Sequence
  Description of Artificial Sequence: Synthetic peptide
DAKILNDVQDR

SEQ ID NO: 5841 - protein, 11 aa, Artificial Sequence
  Description of Artificial Sequence: Synthetic peptide
KSDMDKLAKAT

SEQ ID NO: 5842 - protein, 11 aa, Artificial Sequence
  Description of Artificial Sequence: Synthetic peptide
HVKETALKELN

SEQ ID NO: 5843 - protein, 11 aa, Artificial Sequence
  Description of Artificial Sequence: Synthetic peptide
LRSHDNFKAKL

SEQ ID NO: 5844 - protein, 11 aa, Artificial Sequence
  Description of Artificial Sequence: Synthetic peptide
EITRLVETFKK

SEQ ID NO: 5845 - protein, 11 aa, Artificial Sequence
  Description of Artificial Sequence: Synthetic peptide
HSTLEYKVKER

SEQ ID NO: 5846 - protein, 11 aa, Artificial Sequence
  Description of Artificial Sequence: Synthetic peptide
IHQYREQIKRV

SEQ ID NO: 5847 - protein, 11 aa, Artificial Sequence
  Description of Artificial Sequence: Synthetic peptide
RDLDRQKQKLE

SEQ ID NO: 5848 - protein, 11 aa, Artificial Sequence
  Description of Artificial Sequence: Synthetic peptide
KADIVRQLSER

SEQ ID NO: 5849 - protein, 11 aa, Artificial Sequence
  Description of Artificial Sequence: Synthetic peptide
KKAWENMVTKD

SEQ ID NO: 5850 - protein, 11 aa, Artificial Sequence
  Description of Artificial Sequence: Synthetic peptide
HKFIDTITDHM

SEQ ID NO: 5851 - protein, 11 aa, Artificial Sequence
  Description of Artificial Sequence: Synthetic peptide
PNDLKHYKKLS

SEQ ID NO: 5852 - protein, 11 aa, Artificial Sequence
  Description of Artificial Sequence: Synthetic peptide
RDQGKEMATKY

SEQ ID NO: 5853 - protein, 11 aa, Artificial Sequence
  Description of Artificial Sequence: Synthetic peptide
KGELKQLLTKE

SEQ ID NO: 5854 - protein, 11 aa, Artificial Sequence
  Description of Artificial Sequence: Synthetic peptide
PNDLKHLKKLS

SEQ ID NO: 5855 - protein, 11 aa, Artificial Sequence
  Description of Artificial Sequence: Synthetic peptide
ELKDQLENFRR

SEQ ID NO: 5856 - protein, 11 aa, Artificial Sequence
  Description of Artificial Sequence: Synthetic peptide
VQDLTRELNEK

SEQ ID NO: 5857 - protein, 11 aa, Artificial Sequence
  Description of Artificial Sequence: Synthetic peptide
RTSIDHLKEIA

SEQ ID NO: 5858 - protein, 11 aa, Artificial Sequence
  Description of Artificial Sequence: Synthetic peptide
KDKQLETMARL

SEQ ID NO: 5859 - protein, 11 aa, Artificial Sequence
  Description of Artificial Sequence: Synthetic peptide
LSRAKEFAQKH

SEQ ID NO: 5860 - protein, 11 aa, Artificial Sequence
  Description of Artificial Sequence: Synthetic peptide
LTDLVEHFKKT

SEQ ID NO: 5861 - protein, 11 aa, Artificial Sequence
  Description of Artificial Sequence: Synthetic peptide
FSENLKKAKEK

SEQ ID NO: 5862 - protein, 12 aa, Artificial Sequence
  Description of Artificial Sequence: Synthetic peptide
DKDLEVWNRLTS

SEQ ID NO: 5863 - protein, 12 aa, Artificial Sequence
  Description of Artificial Sequence: Synthetic peptide
QERLDAIVSRTR

SEQ ID NO: 5864 - protein, 12 aa, Artificial Sequence
  Description of Artificial Sequence: Synthetic peptide
VDEVKRQIDLAS

SEQ ID NO: 5865 - protein, 12 aa, Artificial Sequence
  Description of Artificial Sequence: Synthetic peptide
QTKIDAKKEQLA

SEQ ID NO: 5866 - protein, 12 aa, Artificial Sequence
  Description of Artificial Sequence: Synthetic peptide
DNDIQDIRNRIF

SEQ ID NO: 5867 - protein, 12 aa, Artificial Sequence
  Description of Artificial Sequence: Synthetic peptide
LSDFKELLRTVK

SEQ ID NO: 5868 - protein, 12 aa, Artificial Sequence
  Description of Artificial Sequence: Synthetic peptide
KEWEKKISEAIQ

SEQ ID NO: 5869 - protein, 12 aa, Artificial Sequence
  Description of Artificial Sequence: Synthetic peptide
GERFKENIRKVN

SEQ ID NO: 5870 - protein, 12 aa, Artificial Sequence
  Description of Artificial Sequence: Synthetic peptide
ERARTEFISSKL

SEQ ID NO: 5871 - protein, 12 aa, Artificial Sequence
  Description of Artificial Sequence: Synthetic peptide
DIHQYREQIKRV

SEQ ID NO: 5872 - protein, 12 aa, Artificial Sequence
  Description of Artificial Sequence: Synthetic peptide
LDTDYQMTKRDM

SEQ ID NO: 5873 - protein, 12 aa, Artificial Sequence
  Description of Artificial Sequence: Synthetic peptide
IDNVKSKIQDKE

SEQ ID NO: 5874 - protein, 12 aa, Artificial Sequence
  Description of Artificial Sequence: Synthetic peptide
KVLDAIIQEKKS

SEQ ID NO: 5875 - protein, 12 aa, Artificial Sequence
  Description of Artificial Sequence: Synthetic peptide
NAQVKDVEEKYS

SEQ ID NO: 5876 - protein, 12 aa, Artificial Sequence
  Description of Artificial Sequence: Synthetic peptide
HSQFIKLVAEKR

SEQ ID NO: 5877 - protein, 12 aa, Artificial Sequence
  Description of Artificial Sequence: Synthetic peptide
KDVLDELKNYIS

SEQ ID NO: 5878 - protein, 12 aa, Artificial Sequence
  Description of Artificial Sequence: Synthetic peptide
KKTIAAEDVLND

SEQ ID NO: 5879 - protein, 12 aa, Artificial Sequence
  Description of Artificial Sequence: Synthetic peptide
EEAKIIKQYVKN

SEQ ID NO: 5880 - protein, 12 aa, Artificial Sequence
  Description of Artificial Sequence: Synthetic peptide
VTAVKDSFERHL

SEQ ID NO: 5881 - protein, 12 aa, Artificial Sequence
  Description of Artificial Sequence: Synthetic peptide
KGTQGERIVEDY

SEQ ID NO: 5882 - protein, 12 aa, Artificial Sequence
  Description of Artificial Sequence: Synthetic peptide
GTHTKELDLWKS

SEQ ID NO: 5883 - protein, 12 aa, Artificial Sequence
  Description of Artificial Sequence: Synthetic peptide
YDEIKDVVTKLS

SEQ ID NO: 5884 - protein, 12 aa, Artificial Sequence
  Description of Artificial Sequence: Synthetic peptide
QEYVRETIDKLM

SEQ ID NO: 5885 - protein, 12 aa, Artificial Sequence
  Description of Artificial Sequence: Synthetic peptide
KDHLDLLSKSAY

SEQ ID NO: 5886 - protein, 12 aa, Artificial Sequence
  Description of Artificial Sequence: Synthetic peptide
KESIKKALELTM

SEQ ID NO: 5887 - protein, 12 aa, Artificial Sequence
  Description of Artificial Sequence: Synthetic peptide
DGLEVAKTIRKT

SEQ ID NO: 5888 - protein, 12 aa, Artificial Sequence
  Description of Artificial Sequence: Synthetic peptide
HDSIKMFIKNAK

SEQ ID NO: 5889 - protein, 12 aa, Artificial Sequence
  Description of Artificial Sequence: Synthetic peptide
FKNIDDLNKVLK

SEQ ID NO: 5890 - protein, 12 aa, Artificial Sequence
  Description of Artificial Sequence: Synthetic peptide
PQDIQAFRELDK

SEQ ID NO: 5891 - protein, 12 aa, Artificial Sequence
  Description of Artificial Sequence: Synthetic peptide
LKEKENNDSSDK

SEQ ID NO: 5892 - protein, 12 aa, Artificial Sequence
  Description of Artificial Sequence: Synthetic peptide
RDKVNDIVDQVI

SEQ ID NO: 5893 - protein, 12 aa, Artificial Sequence
  Description of Artificial Sequence: Synthetic peptide
RKQFEKTMETSS

SEQ ID NO: 5894 - protein, 12 aa, Artificial Sequence
  Description of Artificial Sequence: Synthetic peptide
QDKLDKIIQRTR

SEQ ID NO: 5895 - protein, 12 aa, Artificial Sequence
  Description of Artificial Sequence: Synthetic peptide
EKETKEMVAFLN

SEQ ID NO: 5896 - protein, 12 aa, Artificial Sequence
  Description of Artificial Sequence: Synthetic peptide
TKDLKKLIWNEI

SEQ ID NO: 5897 - protein, 12 aa, Artificial Sequence
  Description of Artificial Sequence: Synthetic peptide
TKEREQVIAHLG

SEQ ID NO: 5898 - protein, 12 aa, Artificial Sequence
  Description of Artificial Sequence: Synthetic peptide
NEEWDLLISGKK

SEQ ID NO: 5899 - protein, 12 aa, Artificial Sequence
  Description of Artificial Sequence: Synthetic peptide
ETTERLLKQAVE

SEQ ID NO: 5900 - protein, 12 aa, Artificial Sequence
  Description of Artificial Sequence: Synthetic peptide
DSTRQRIVELAH

SEQ ID NO: 5901 - protein, 12 aa, Artificial Sequence
  Description of Artificial Sequence: Synthetic peptide
DRDTLKNLGDRL

SEQ ID NO: 5902 - protein, 12 aa, Artificial Sequence
  Description of Artificial Sequence: Synthetic peptide
LAHLRAHQRTHT

SEQ ID NO: 5903 - protein, 12 aa, Artificial Sequence
  Description of Artificial Sequence: Synthetic peptide
LAEVSQRHAEKL

SEQ ID NO: 5904 - protein, 12 aa, Artificial Sequence
  Description of Artificial Sequence: Synthetic peptide
AASFLTRMKEKH

SEQ ID NO: 5905 - protein, 12 aa, Artificial Sequence
  Description of Artificial Sequence: Synthetic peptide
ADREKQIITHLN

SEQ ID NO: 5906 - protein, 12 aa, Artificial Sequence
  Description of Artificial Sequence: Synthetic peptide
MESTFERIKELS

SEQ ID NO: 5907 - protein, 12 aa, Artificial Sequence
  Description of Artificial Sequence: Synthetic peptide
ELQRLFRDAHMT

SEQ ID NO: 5908 - protein, 12 aa, Artificial Sequence
  Description of Artificial Sequence: Synthetic peptide
EHRALRKVVSSA

SEQ ID NO: 5909 - protein, 12 aa, Artificial Sequence
  Description of Artificial Sequence: Synthetic peptide
GEQRKTFVELMR

SEQ ID NO: 5910 - protein, 12 aa, Artificial Sequence
  Description of Artificial Sequence: Synthetic peptide
SEKIQKEVESLI

SEQ ID NO: 5911 - protein, 12 aa, Artificial Sequence
  Description of Artificial Sequence: Synthetic peptide
ISKVREMQKWLE

SEQ ID NO: 5912 - protein, 12 aa, Artificial Sequence
  Description of Artificial Sequence: Synthetic peptide
TQERDRLIDDFR

SEQ ID NO: 5913 - protein, 12 aa, Artificial Sequence
  Description of Artificial Sequence: Synthetic peptide
DAQRQATKDAGR

SEQ ID NO: 5914 - protein, 12 aa, Artificial Sequence
  Description of Artificial Sequence: Synthetic peptide
EDRMELYQTRLS

SEQ ID NO: 5915 - protein, 12 aa, Artificial Sequence
  Description of Artificial Sequence: Synthetic peptide
TSELREAMRKLL

SEQ ID NO: 5916 - protein, 12 aa, Artificial Sequence
  Description of Artificial Sequence: Synthetic peptide
TVEAYKTIAREE

SEQ ID NO: 5917 - protein, 12 aa, Artificial Sequence
  Description of Artificial Sequence: Synthetic peptide
KASLNWHMKKHD

SEQ ID NO: 5918 - protein, 12 aa, Artificial Sequence
  Description of Artificial Sequence: Synthetic peptide
DDVKSIVRFVQE

SEQ ID NO: 5919 - protein, 12 aa, Artificial Sequence
  Description of Artificial Sequence: Synthetic peptide
PTVRELKETLEN

SEQ ID NO: 5920 - protein, 12 aa, Artificial Sequence
  Description of Artificial Sequence: Synthetic peptide
ENVTELKKNFNR

SEQ ID NO: 5921 - protein, 12 aa, Artificial Sequence
  Description of Artificial Sequence: Synthetic peptide
RHDILSAFDTRI

SEQ ID NO: 5922 - protein, 12 aa, Artificial Sequence
  Description of Artificial Sequence: Synthetic peptide
TDSRNVDDYVRK

SEQ ID NO: 5923 - protein, 12 aa, Artificial Sequence
  Description of Artificial Sequence: Synthetic peptide
REGYEKLKQELN

SEQ ID NO: 5924 - protein, 12 aa, Artificial Sequence
  Description of Artificial Sequence: Synthetic peptide
IYQQVRDELKRA

SEQ ID NO: 5925 - protein, 12 aa, Artificial Sequence
  Description of Artificial Sequence: Synthetic peptide
SDHLAEHQRTHT

SEQ ID NO: 5926 - protein, 12 aa, Artificial Sequence
  Description of Artificial Sequence: Synthetic peptide
HWGDRSADMATR

SEQ ID NO: 5927 - protein, 12 aa, Artificial Sequence
  Description of Artificial Sequence: Synthetic peptide
KSGQLLHELLKE

SEQ ID NO: 5928 - protein, 12 aa, Artificial Sequence
  Description of Artificial Sequence: Synthetic peptide
EALSKLLERIKQ

SEQ ID NO: 5929 - protein, 12 aa, Artificial Sequence
  Description of Artificial Sequence: Synthetic peptide
RDLTDLMAKNME

SEQ ID NO: 5930 - protein, 12 aa, Artificial Sequence
  Description of Artificial Sequence: Synthetic peptide
RYDTLVSVLERE

SEQ ID NO: 5931 - protein, 12 aa, Artificial Sequence
  Description of Artificial Sequence: Synthetic peptide
QKEIDRLNEVAK

SEQ ID NO: 5932 - protein, 12 aa, Artificial Sequence
  Description of Artificial Sequence: Synthetic peptide
ESLVEKVKEFLS

SEQ ID NO: 5933 - protein, 12 aa, Artificial Sequence
  Description of Artificial Sequence: Synthetic peptide
KEDALKLVQLKQ

SEQ ID NO: 5934 - protein, 12 aa, Artificial Sequence
  Description of Artificial Sequence: Synthetic peptide
VEQLRKEGNELF

SEQ ID NO: 5935 - protein, 12 aa, Artificial Sequence
  Description of Artificial Sequence: Synthetic peptide
KTQMQEKAKEIY

SEQ ID NO: 5936 - protein, 12 aa, Artificial Sequence
  Description of Artificial Sequence: Synthetic peptide
LNTKVEVLREVE

SEQ ID NO: 5937 - protein, 12 aa, Artificial Sequence
  Description of Artificial Sequence: Synthetic peptide
QLKSVIKKYREE

SEQ ID NO: 5938 - protein, 12 aa, Artificial Sequence
  Description of Artificial Sequence: Synthetic peptide
TSKWIDDVRTER

SEQ ID NO: 5939 - protein, 12 aa, Artificial Sequence
  Description of Artificial Sequence: Synthetic peptide
KDEIDSKLVNFI

SEQ ID NO: 5940 - protein, 12 aa, Artificial Sequence
  Description of Artificial Sequence: Synthetic peptide
SDMRTEIIRMME

SEQ ID NO: 5941 - protein, 12 aa, Artificial Sequence
  Description of Artificial Sequence: Synthetic peptide
TTKWIDDVRTER

SEQ ID NO: 5942 - protein, 12 aa, Artificial Sequence
  Description of Artificial Sequence: Synthetic peptide
EIHLENMLKITR

SEQ ID NO: 5943 - protein, 12 aa, Artificial Sequence
  Description of Artificial Sequence: Synthetic peptide
RLDLDFHQRVHT

SEQ ID NO: 5944 - protein, 12 aa, Artificial Sequence
  Description of Artificial Sequence: Synthetic peptide
KSQLIIHERIHT

SEQ ID NO: 5945 - protein, 12 aa, Artificial Sequence
  Description of Artificial Sequence: Synthetic peptide
SVERYIVSRLRD

SEQ ID NO: 5946 - protein, 12 aa, Artificial Sequence
  Description of Artificial Sequence: Synthetic peptide
KHDVETFRQLIG

SEQ ID NO: 5947 - protein, 12 aa, Artificial Sequence
  Description of Artificial Sequence: Synthetic peptide
YEKARTLIEKVS

SEQ ID NO: 5948 - protein, 12 aa, Artificial Sequence
  Description of Artificial Sequence: Synthetic peptide
ELSDRVLRAAKQ

SEQ ID NO: 5949 - protein, 12 aa, Artificial Sequence
  Description of Artificial Sequence: Synthetic peptide
KDQLMEKYRKIT

SEQ ID NO: 5950 - protein, 12 aa, Artificial Sequence
  Description of Artificial Sequence: Synthetic peptide
PERELTETREKL

SEQ ID NO: 5951 - protein, 12 aa, Artificial Sequence
  Description of Artificial Sequence: Synthetic peptide
ELKELIRKHQND

SEQ ID NO: 5952 - protein, 12 aa, Artificial Sequence
  Description of Artificial Sequence: Synthetic peptide
FDDIKKIISKQL

SEQ ID NO: 5953 - protein, 12 aa, Artificial Sequence
  Description of Artificial Sequence: Synthetic peptide
ITRDSVIRIAKD

SEQ ID NO: 5954 - protein, 12 aa, Artificial Sequence
  Description of Artificial Sequence: Synthetic peptide
WKDAIKEMKQTI

SEQ ID NO: 5955 - protein, 12 aa, Artificial Sequence
  Description of Artificial Sequence: Synthetic peptide
ESAVRVVERLNR

SEQ ID NO: 5956 - protein, 12 aa, Artificial Sequence
  Description of Artificial Sequence: Synthetic peptide
DLKALSSALHER

SEQ ID NO: 5957 - protein, 12 aa, Artificial Sequence
  Description of Artificial Sequence: Synthetic peptide
VDRGTELLERSL

SEQ ID NO: 5958 - protein, 12 aa, Artificial Sequence
  Description of Artificial Sequence: Synthetic peptide
GETHRHRKQMFM

SEQ ID NO: 5959 - protein, 12 aa, Artificial Sequence
  Description of Artificial Sequence: Synthetic peptide
KETENKIIKDYK

SEQ ID NO: 5960 - protein, 12 aa, Artificial Sequence
  Description of Artificial Sequence: Synthetic peptide
KDKLLSFLDTHL

SEQ ID NO: 5961 - protein, 12 aa, Artificial Sequence
  Description of Artificial Sequence: Synthetic peptide
EIAKETQARVLE

SEQ ID NO: 5962 - protein, 12 aa, Artificial Sequence
  Description of Artificial Sequence: Synthetic peptide
YTERDRIQRERL

SEQ ID NO: 5963 - protein, 12 aa, Artificial Sequence
  Description of Artificial Sequence: Synthetic peptide
DTERAQLDVMKL

SEQ ID NO: 5964 - protein, 12 aa, Artificial Sequence
  Description of Artificial Sequence: Synthetic peptide
LTLLEKTLKERL

SEQ ID NO: 5965 - protein, 12 aa, Artificial Sequence
  Description of Artificial Sequence: Synthetic peptide
RKITDDLVKNVE

SEQ ID NO: 5966 - protein, 12 aa, Artificial Sequence
  Description of Artificial Sequence: Synthetic peptide
QETIKHVKDLIA

SEQ ID NO: 5967 - protein, 12 aa, Artificial Sequence
  Description of Artificial Sequence: Synthetic peptide
TDVDQKVDQVAR

SEQ ID NO: 5968 - protein, 12 aa, Artificial Sequence
  Description of Artificial Sequence: Synthetic peptide
SDITDEQKKVRE

SEQ ID NO: 5969 - protein, 12 aa, Artificial Sequence
  Description of Artificial Sequence: Synthetic peptide
ENSRVLVKKLAE

SEQ ID NO: 5970 - protein, 12 aa, Artificial Sequence
  Description of Artificial Sequence: Synthetic peptide
TDTALKELEKVT

SEQ ID NO: 5971 - protein, 12 aa, Artificial Sequence
  Description of Artificial Sequence: Synthetic peptide
HKFIDTITDHMT

SEQ ID NO: 5972 - protein, 12 aa, Artificial Sequence
  Description of Artificial Sequence: Synthetic peptide
DETLAKIKKAWN

SEQ ID NO: 5973 - protein, 12 aa, Artificial Sequence
  Description of Artificial Sequence: Synthetic peptide
KGTQADRIVEKY

SEQ ID NO: 5974 - protein, 12 aa, Artificial Sequence
  Description of Artificial Sequence: Synthetic peptide
TGRIYSDVLRKE

SEQ ID NO: 5975 - protein, 12 aa, Artificial Sequence
  Description of Artificial Sequence: Synthetic peptide
NEDFVRLSTEAR

SEQ ID NO: 5976 - protein, 12 aa, Artificial Sequence
  Description of Artificial Sequence: Synthetic peptide
PRFQELKSETLK

SEQ ID NO: 5977 - protein, 12 aa, Artificial Sequence
  Description of Artificial Sequence: Synthetic peptide
ARAQAKQLEHLK

SEQ ID NO: 5978 - protein, 12 aa, Artificial Sequence
  Description of Artificial Sequence: Synthetic peptide
EVSINDARVRAR

SEQ ID NO: 5979 - protein, 12 aa, Artificial Sequence
  Description of Artificial Sequence: Synthetic peptide
EFKLTSAIKKEL

SEQ ID NO: 5980 - protein, 12 aa, Artificial Sequence
  Description of Artificial Sequence: Synthetic peptide
KETSDLLRKIAA

SEQ ID NO: 5981 - protein, 12 aa, Artificial Sequence
  Description of Artificial Sequence: Synthetic peptide
EHTSDRKLLAKE

SEQ ID NO: 5982 - protein, 12 aa, Artificial Sequence
  Description of Artificial Sequence: Synthetic peptide
KDKTKGDAIDLS

SEQ ID NO: 5983 - protein, 12 aa, Artificial Sequence
  Description of Artificial Sequence: Synthetic peptide
ETATRDQLTKEA

SEQ ID NO: 5984 - protein, 12 aa, Artificial Sequence
  Description of Artificial Sequence: Synthetic peptide
PEDKTTVHRKWS

SEQ ID NO: 5985 - protein, 12 aa, Artificial Sequence
  Description of Artificial Sequence: Synthetic peptide
MNEGARHMREFT

SEQ ID NO: 5986 - protein, 12 aa, Artificial Sequence
  Description of Artificial Sequence: Synthetic peptide
REKDLSWITQHA

SEQ ID NO: 5987 - protein, 12 aa, Artificial Sequence
  Description of Artificial Sequence: Synthetic peptide
DQVKEEMKILVQ

SEQ ID NO: 5988 - protein, 12 aa, Artificial Sequence
  Description of Artificial Sequence: Synthetic peptide
EDDLTKVLNYTK

SEQ ID NO: 5989 - protein, 12 aa, Artificial Sequence
  Description of Artificial Sequence: Synthetic peptide
ERANELVESYRK

SEQ ID NO: 5990 - protein, 12 aa, Artificial Sequence
  Description of Artificial Sequence: Synthetic peptide
RTSIDHLKEIAR

SEQ ID NO: 5991 - protein, 12 aa, Artificial Sequence
  Description of Artificial Sequence: Synthetic peptide
KDDLARIITAES

SEQ ID NO: 5992 - protein, 12 aa, Artificial Sequence
  Description of Artificial Sequence: Synthetic peptide
SKLLRDSHVLHS

SEQ ID NO: 5993 - protein, 12 aa, Artificial Sequence
  Description of Artificial Sequence: Synthetic peptide
ATDLKETAKKLL

SEQ ID NO: 5994 - protein, 12 aa, Artificial Sequence
  Description of Artificial Sequence: Synthetic peptide
RTTRELVGDLLD

SEQ ID NO: 5995 - protein, 12 aa, Artificial Sequence
  Description of Artificial Sequence: Synthetic peptide
NSTIDKRVERLI

SEQ ID NO: 5996 - protein, 12 aa, Artificial Sequence
  Description of Artificial Sequence: Synthetic peptide
PSKYRDELTAKL

SEQ ID NO: 5997 - protein, 12 aa, Artificial Sequence
  Description of Artificial Sequence: Synthetic peptide
EKEYKELRNAIS

SEQ ID NO: 5998 - protein, 12 aa, Artificial Sequence
  Description of Artificial Sequence: Synthetic peptide
EKTLRDKLVLAT

SEQ ID NO: 5999 - protein, 12 aa, Artificial Sequence
  Description of Artificial Sequence: Synthetic peptide
LFDRLDEHARQN

SEQ ID NO: 6000 - protein, 12 aa, Artificial Sequence
  Description of Artificial Sequence: Synthetic peptide
LDTDYQMTKKDM

SEQ ID NO: 6001 - protein, 12 aa, Artificial Sequence
  Description of Artificial Sequence: Synthetic peptide
RKHEQMFREAVN

SEQ ID NO: 6002 - protein, 12 aa, Artificial Sequence
  Description of Artificial Sequence: Synthetic peptide
KESLEALDAAKT

SEQ ID NO: 6003 - protein, 12 aa, Artificial Sequence
  Description of Artificial Sequence: Synthetic peptide
HDVYRDEALNNR

SEQ ID NO: 6004 - protein, 12 aa, Artificial Sequence
  Description of Artificial Sequence: Synthetic peptide
EKDIENFMKNEK

SEQ ID NO: 6005 - protein, 12 aa, Artificial Sequence
  Description of Artificial Sequence: Synthetic peptide
DFNLRTHVRIHT

SEQ ID NO: 6006 - protein, 12 aa, Artificial Sequence
  Description of Artificial Sequence: Synthetic peptide
ATQVEEKLRAEY

SEQ ID NO: 6007 - protein, 12 aa, Artificial Sequence
  Description of Artificial Sequence: Synthetic peptide
KVTHFERLHHKT

SEQ ID NO: 6008 - protein, 12 aa, Artificial Sequence
  Description of Artificial Sequence: Synthetic peptide
KEELELANWISK

SEQ ID NO: 6009 - protein, 12 aa, Artificial Sequence
  Description of Artificial Sequence: Synthetic peptide
HDIYRDEALNNR

SEQ ID NO: 6010 - protein, 12 aa, Artificial Sequence
  Description of Artificial Sequence: Synthetic peptide
RDELNAYKSKLK

SEQ ID NO: 6011 - protein, 12 aa, Artificial Sequence
  Description of Artificial Sequence: Synthetic peptide
IENVKAKIQDKL

SEQ ID NO: 6012 - protein, 12 aa, Artificial Sequence
  Description of Artificial Sequence: Synthetic peptide
PEDKVKAVTKLN

SEQ ID NO: 6013 - protein, 12 aa, Artificial Sequence
  Description of Artificial Sequence: Synthetic peptide
KTVEEIDQKLKS

SEQ ID NO: 6014 - protein, 12 aa, Artificial Sequence
  Description of Artificial Sequence: Synthetic peptide
KDRLVESVQDVL

SEQ ID NO: 6015 - protein, 12 aa, Artificial Sequence
  Description of Artificial Sequence: Synthetic peptide
KQERTLFKELIK

SEQ ID NO: 6016 - protein, 12 aa, Artificial Sequence
  Description of Artificial Sequence: Synthetic peptide
EKVVSELKQLAE

SEQ ID NO: 6017 - protein, 12 aa, Artificial Sequence
  Description of Artificial Sequence: Synthetic peptide
QEKLDAMVERTR

SEQ ID NO: 6018 - protein, 12 aa, Artificial Sequence
  Description of Artificial Sequence: Synthetic peptide
MKTRFKIQHATE

SEQ ID NO: 6019 - protein, 12 aa, Artificial Sequence
  Description of Artificial Sequence: Synthetic peptide
QYIEGEMRTRIR

SEQ ID NO: 6020 - protein, 12 aa, Artificial Sequence
  Description of Artificial Sequence: Synthetic peptide
SVTRVKIALEEK

SEQ ID NO: 6021 - protein, 12 aa, Artificial Sequence
  Description of Artificial Sequence: Synthetic peptide
MRDASQWIKRME

SEQ ID NO: 6022 - protein, 12 aa, Artificial Sequence
  Description of Artificial Sequence: Synthetic peptide
RKDRDTARQLHE

SEQ ID NO: 6023 - protein, 12 aa, Artificial Sequence
  Description of Artificial Sequence: Synthetic peptide
HELNSKIKDLET

SEQ ID NO: 6024 - protein, 12 aa, Artificial Sequence
  Description of Artificial Sequence: Synthetic peptide
DGTRLLDSIRDL

SEQ ID NO: 6025 - protein, 12 aa, Artificial Sequence
  Description of Artificial Sequence: Synthetic peptide
LIDVYKKTLKSD

SEQ ID NO: 6026 - protein, 12 aa, Artificial Sequence
  Description of Artificial Sequence: Synthetic peptide
KERLKELIFQET

SEQ ID NO: 6027 - protein, 12 aa, Artificial Sequence
  Description of Artificial Sequence: Synthetic peptide
SRINEARKEVEM

SEQ ID NO: 6028 - protein, 12 aa, Artificial Sequence
  Description of Artificial Sequence: Synthetic peptide
PDDIAELKTRLT

SEQ ID NO: 6029 - protein, 12 aa, Artificial Sequence
  Description of Artificial Sequence: Synthetic peptide
HLDQLKEIMKVT

SEQ ID NO: 6030 - protein, 12 aa, Artificial Sequence
  Description of Artificial Sequence: Synthetic peptide
REMVDQINRVAR

SEQ ID NO: 6031 - protein, 12 aa, Artificial Sequence
  Description of Artificial Sequence: Synthetic peptide
HSKYREEAMQNR

SEQ ID NO: 6032 - protein, 12 aa, Artificial Sequence
  Description of Artificial Sequence: Synthetic peptide
ADTIKKLTDKIK

SEQ ID NO: 6033 - protein, 12 aa, Artificial Sequence
  Description of Artificial Sequence: Synthetic peptide
KIVELENEFLKS

SEQ ID NO: 6034 - protein, 12 aa, Artificial Sequence
  Description of Artificial Sequence: Synthetic peptide
LDDFNREIVKQL

SEQ ID NO: 6035 - protein, 12 aa, Artificial Sequence
  Description of Artificial Sequence: Synthetic peptide
ISSYKEKLEKEH

SEQ ID NO: 6036 - protein, 12 aa, Artificial Sequence
  Description of Artificial Sequence: Synthetic peptide
LRKQLSLDVLDK

SEQ ID NO: 6037 - protein, 12 aa, Artificial Sequence
  Description of Artificial Sequence: Synthetic peptide
REEFTKKVRTNA

SEQ ID NO: 6038 - protein, 12 aa, Artificial Sequence
  Description of Artificial Sequence: Synthetic peptide
KEEKSAIRDYTK

SEQ ID NO: 6039 - protein, 12 aa, Artificial Sequence
  Description of Artificial Sequence: Synthetic peptide
LDKVLSKLSEKY

SEQ ID NO: 6040 - protein, 12 aa, Artificial Sequence
  Description of Artificial Sequence: Synthetic peptide
EKTAEDFTPTVR

SEQ ID NO: 6041 - protein, 12 aa, Artificial Sequence
  Description of Artificial Sequence: Synthetic peptide
SIDKSELLYKVD

SEQ ID NO: 6042 - protein, 12 aa, Artificial Sequence
  Description of Artificial Sequence: Synthetic peptide
KRIIKETEKLVS

SEQ ID NO: 6043 - protein, 12 aa, Artificial Sequence
  Description of Artificial Sequence: Synthetic peptide
TAEEFANRLSKD

SEQ ID NO: 6044 - protein, 12 aa, Artificial Sequence
  Description of Artificial Sequence: Synthetic peptide
LDNLRDTVRKFL

SEQ ID NO: 6045 - protein, 12 aa, Artificial Sequence
  Description of Artificial Sequence: Synthetic peptide
EKAKNRLNTELY

SEQ ID NO: 6046 - protein, 12 aa, Artificial Sequence
  Description of Artificial Sequence: Synthetic peptide
APEHTRLRKLVT

SEQ ID NO: 6047 - protein, 12 aa, Artificial Sequence
  Description of Artificial Sequence: Synthetic peptide
QHSAELIKHLIK

SEQ ID NO: 6048 - protein, 12 aa, Artificial Sequence
  Description of Artificial Sequence: Synthetic peptide
KEQKTQRLISEL

SEQ ID NO: 6049 - protein, 12 aa, Artificial Sequence
  Description of Artificial Sequence: Synthetic peptide
KDHFVKLETIDS

SEQ ID NO: 6050 - protein, 12 aa, Artificial Sequence
  Description of Artificial Sequence: Synthetic peptide
REMLASIDTLKD

SEQ ID NO: 6051 - protein, 12 aa, Artificial Sequence
  Description of Artificial Sequence: Synthetic peptide
ADEIKTAIDTAR

SEQ ID NO: 6052 - protein, 12 aa, Artificial Sequence
  Description of Artificial Sequence: Synthetic peptide
LSEKEALIKQIK

SEQ ID NO: 6053 - protein, 12 aa, Artificial Sequence
  Description of Artificial Sequence: Synthetic peptide
KDQEIKKLVDQN

SEQ ID NO: 6054 - protein, 12 aa, Artificial Sequence
  Description of Artificial Sequence: Synthetic peptide
ENLKRYVERMES

SEQ ID NO: 6055 - protein, 12 aa, Artificial Sequence
  Description of Artificial Sequence: Synthetic peptide
QSTLDKLMRDLD

SEQ ID NO: 6056 - protein, 12 aa, Artificial Sequence
  Description of Artificial Sequence: Synthetic peptide
AKDIADAVRKTS

SEQ ID NO: 6057 - protein, 12 aa, Artificial Sequence
  Description of Artificial Sequence: Synthetic peptide
DNALRKSHHAGM

SEQ ID NO: 6058 - protein, 12 aa, Artificial Sequence
  Description of Artificial Sequence: Synthetic peptide
DEVTNGIVKERL

SEQ ID NO: 6059 - protein, 12 aa, Artificial Sequence
  Description of Artificial Sequence: Synthetic peptide
KDITQKYRTILD

SEQ ID NO: 6060 - protein, 12 aa, Artificial Sequence
  Description of Artificial Sequence: Synthetic peptide
IENVKAKIQDKI

SEQ ID NO: 6061 - protein, 12 aa, Artificial Sequence
  Description of Artificial Sequence: Synthetic peptide
KDTVEKVRQTFE

SEQ ID NO: 6062 - protein, 12 aa, Artificial Sequence
  Description of Artificial Sequence: Synthetic peptide
EDRVKEVVTKYS

SEQ ID NO: 6063 - protein, 12 aa, Artificial Sequence
  Description of Artificial Sequence: Synthetic peptide
QMERVRTLTDVR

SEQ ID NO: 6064 - protein, 12 aa, Artificial Sequence
  Description of Artificial Sequence: Synthetic peptide
LKERYQKIGDTK

SEQ ID NO: 6065 - protein, 12 aa, Artificial Sequence
  Description of Artificial Sequence: Synthetic peptide
SKENMSLLKHLK

SEQ ID NO: 6066 - protein, 12 aa, Artificial Sequence
  Description of Artificial Sequence: Synthetic peptide
KGTQAERIVEKY

SEQ ID NO: 6067 - protein, 12 aa, Artificial Sequence
  Description of Artificial Sequence: Synthetic peptide
KGTQGEKIVEDY

SEQ ID NO: 6068 - protein, 12 aa, Artificial Sequence
  Description of Artificial Sequence: Synthetic peptide
RKESHLEKQKID

SEQ ID NO: 6069 - protein, 12 aa, Artificial Sequence
  Description of Artificial Sequence: Synthetic peptide
ASADAERLHRSM

SEQ ID NO: 6070 - protein, 12 aa, Artificial Sequence
  Description of Artificial Sequence: Synthetic peptide
KIGKEHINRITN

SEQ ID NO: 6071 - protein, 12 aa, Artificial Sequence
  Description of Artificial Sequence: Synthetic peptide
KESLLREVQLLK

SEQ ID NO: 6072 - protein, 12 aa, Artificial Sequence
  Description of Artificial Sequence: Synthetic peptide
RVRNQFLKEMDG

SEQ ID NO: 6073 - protein, 12 aa, Artificial Sequence
  Description of Artificial Sequence: Synthetic peptide
RADIMTKLNEDF

SEQ ID NO: 6074 - protein, 12 aa, Artificial Sequence
  Description of Artificial Sequence: Synthetic peptide
SRGRDLLTDWLK

SEQ ID NO: 6075 - protein, 12 aa, Artificial Sequence
  Description of Artificial Sequence: Synthetic peptide
PDRLAQIVERTR

SEQ ID NO: 6076 - protein, 12 aa, Artificial Sequence
  Description of Artificial Sequence: Synthetic peptide
SDKLQKEVEGLV

SEQ ID NO: 6077 - protein, 12 aa, Artificial Sequence
  Description of Artificial Sequence: Synthetic peptide
PKTQLLHFIREE

SEQ ID NO: 6078 - protein, 12 aa, Artificial Sequence
  Description of Artificial Sequence: Synthetic peptide
NEYRHLQHSIKE

SEQ ID NO: 6079 - protein, 12 aa, Artificial Sequence
  Description of Artificial Sequence: Synthetic peptide
KWVQDSMDHLDK

SEQ ID NO: 6080 - protein, 12 aa, Artificial Sequence
  Description of Artificial Sequence: Synthetic peptide
QFELLERANHKL

SEQ ID NO: 6081 - protein, 12 aa, Artificial Sequence
  Description of Artificial Sequence: Synthetic peptide
DMRTEVIRMMES

SEQ ID NO: 6082 - protein, 12 aa, Artificial Sequence
  Description of Artificial Sequence: Synthetic peptide
KQREVLLKTLYH

SEQ ID NO: 6083 - protein, 12 aa, Artificial Sequence
  Description of Artificial Sequence: Synthetic peptide
RETMLEVVERTA

SEQ ID NO: 6084 - protein, 12 aa, Artificial Sequence
  Description of Artificial Sequence: Synthetic peptide
ENEAFKIDTRIG

SEQ ID NO: 6085 - protein, 12 aa, Artificial Sequence
  Description of Artificial Sequence: Synthetic peptide
AETIDKLVERTR

SEQ ID NO: 6086 - protein, 12 aa, Artificial Sequence
  Description of Artificial Sequence: Synthetic peptide
KVDMAREISKQL

SEQ ID NO: 6087 - protein, 12 aa, Artificial Sequence
  Description of Artificial Sequence: Synthetic peptide
QRDREEALHQFR

SEQ ID NO: 6088 - protein, 12 aa, Artificial Sequence
  Description of Artificial Sequence: Synthetic peptide
YDEMVETMRKIS

SEQ ID NO: 6089 - protein, 12 aa, Artificial Sequence
  Description of Artificial Sequence: Synthetic peptide
KSEKEAIVSYTK

SEQ ID NO: 6090 - protein, 12 aa, Artificial Sequence
  Description of Artificial Sequence: Synthetic peptide
DAKARDVVNRLT

SEQ ID NO: 6091 - protein, 12 aa, Artificial Sequence
  Description of Artificial Sequence: Synthetic peptide
DDVQKVFQVAKE

SEQ ID NO: 6092 - protein, 12 aa, Artificial Sequence
  Description of Artificial Sequence: Synthetic peptide
KKQDDNLEHFIS

SEQ ID NO: 6093 - protein, 12 aa, Artificial Sequence
  Description of Artificial Sequence: Synthetic peptide
NVTFRKELEKIL

SEQ ID NO: 6094 - protein, 12 aa, Artificial Sequence
  Description of Artificial Sequence: Synthetic peptide
IQGKVDEVFRKQ

SEQ ID NO: 6095 - protein, 12 aa, Artificial Sequence
  Description of Artificial Sequence: Synthetic peptide
EDKAVELYSRTA

SEQ ID NO: 6096 - protein, 12 aa, Artificial Sequence
  Description of Artificial Sequence: Synthetic peptide
DEQRKLLKEAQA

SEQ ID NO: 6097 - protein, 12 aa, Artificial Sequence
  Description of Artificial Sequence: Synthetic peptide
PTIIKDHLKKAN

SEQ ID NO: 6098 - protein, 12 aa, Artificial Sequence
  Description of Artificial Sequence: Synthetic peptide
ELKKLELLRQNA

SEQ ID NO: 6099 - protein, 12 aa, Artificial Sequence
  Description of Artificial Sequence: Synthetic peptide
ETIKLLEKILES

SEQ ID NO: 6100 - protein, 12 aa, Artificial Sequence
  Description of Artificial Sequence: Synthetic peptide
TDNVVEKLRKKY

SEQ ID NO: 6101 - protein, 12 aa, Artificial Sequence
  Description of Artificial Sequence: Synthetic peptide
VDEALKDAQTRI

SEQ ID NO: 6102 - protein, 12 aa, Artificial Sequence
  Description of Artificial Sequence: Synthetic peptide
KVFETLEARMTE

SEQ ID NO: 6103 - protein, 12 aa, Artificial Sequence
  Description of Artificial Sequence: Synthetic peptide
ARDVLDNLFEKT

SEQ ID NO: 6104 - protein, 12 aa, Artificial Sequence
  Description of Artificial Sequence: Synthetic peptide
PVLDRVLENNHR

SEQ ID NO: 6105 - protein, 12 aa, Artificial Sequence
  Description of Artificial Sequence: Synthetic peptide
DFSNQLRAELEK

SEQ ID NO: 6106 - protein, 12 aa, Artificial Sequence
  Description of Artificial Sequence: Synthetic peptide
DKERSIISDIFS

SEQ ID NO: 6107 - protein, 12 aa, Artificial Sequence
  Description of Artificial Sequence: Synthetic peptide
EEHTYLHAQRQK

SEQ ID NO: 6108 - protein, 12 aa, Artificial Sequence
  Description of Artificial Sequence: Synthetic peptide
RDLRKAMQQTLE

SEQ ID NO: 6109 - protein, 12 aa, Artificial Sequence
  Description of Artificial Sequence: Synthetic peptide
KSELDAYTKKLV

SEQ ID NO: 6110 - protein, 12 aa, Artificial Sequence
  Description of Artificial Sequence: Synthetic peptide
EKDRNDLITYLK

SEQ ID NO: 6111 - protein, 12 aa, Artificial Sequence
  Description of Artificial Sequence: Synthetic peptide
TRKLSETVLEDV

SEQ ID NO: 6112 - protein, 12 aa, Artificial Sequence
  Description of Artificial Sequence: Synthetic peptide
DEMVETMRKISG

SEQ ID NO: 6113 - protein, 12 aa, Artificial Sequence
  Description of Artificial Sequence: Synthetic peptide
SDKIKKFLTESH

SEQ ID NO: 6114 - protein, 12 aa, Artificial Sequence
  Description of Artificial Sequence: Synthetic peptide
KETKALADFIRN

SEQ ID NO: 6115 - protein, 12 aa, Artificial Sequence
  Description of Artificial Sequence: Synthetic peptide
LSELENFKKELA

SEQ ID NO: 6116 - protein, 12 aa, Artificial Sequence
  Description of Artificial Sequence: Synthetic peptide
RVEKTLELIKQA

SEQ ID NO: 6117 - protein, 12 aa, Artificial Sequence
  Description of Artificial Sequence: Synthetic peptide
HEQKTRYLPRVA

SEQ ID NO: 6118 - protein, 12 aa, Artificial Sequence
  Description of Artificial Sequence: Synthetic peptide
KDVYEKTESIMG

SEQ ID NO: 6119 - protein, 12 aa, Artificial Sequence
  Description of Artificial Sequence: Synthetic peptide
YSHRAAQRERLA

SEQ ID NO: 6120 - protein, 12 aa, Artificial Sequence
  Description of Artificial Sequence: Synthetic peptide
SDHLTTHIRTHT

SEQ ID NO: 6121 - protein, 12 aa, Artificial Sequence
  Description of Artificial Sequence: Synthetic peptide
PSGTFVREKIRE

SEQ ID NO: 6122 - protein, 12 aa, Artificial Sequence
  Description of Artificial Sequence: Synthetic peptide
NDKRVHRLLTVL

SEQ ID NO: 6123 - protein, 12 aa, Artificial Sequence
  Description of Artificial Sequence: Synthetic peptide
ADELSNAKKVRA

SEQ ID NO: 6124 - protein, 12 aa, Artificial Sequence
  Description of Artificial Sequence: Synthetic peptide
TEKAWEVLTKAR

SEQ ID NO: 6125 - protein, 12 aa, Artificial Sequence
  Description of Artificial Sequence: Synthetic peptide
IIDKLYEKVSKN

SEQ ID NO: 6126 - protein, 12 aa, Artificial Sequence
  Description of Artificial Sequence: Synthetic peptide
EKSLTDAVKLAH

SEQ ID NO: 6127 - protein, 12 aa, Artificial Sequence
  Description of Artificial Sequence: Synthetic peptide
EDIARKEQLKSL

SEQ ID NO: 6128 - protein, 12 aa, Artificial Sequence
  Description of Artificial Sequence: Synthetic peptide
KSDKDAIVNAWK

SEQ ID NO: 6129 - protein, 12 aa, Artificial Sequence
  Description of Artificial Sequence: Synthetic peptide
EKLNQLWEKAQR

SEQ ID NO: 6130 - protein, 12 aa, Artificial Sequence
  Description of Artificial Sequence: Synthetic peptide
PLEFLRANQRKH

SEQ ID NO: 6131 - protein, 12 aa, Artificial Sequence
  Description of Artificial Sequence: Synthetic peptide
TDSAEGVRKFIR

SEQ ID NO: 6132 - protein, 12 aa, Artificial Sequence
  Description of Artificial Sequence: Synthetic peptide
EADITAIKRLSD

SEQ ID NO: 6133 - protein, 12 aa, Artificial Sequence
  Description of Artificial Sequence: Synthetic peptide
QEDLDKIFINVR

SEQ ID NO: 6134 - protein, 12 aa, Artificial Sequence
  Description of Artificial Sequence: Synthetic peptide
SNRHKEFENQIR

SEQ ID NO: 6135 - protein, 12 aa, Artificial Sequence
  Description of Artificial Sequence: Synthetic peptide
QKELLEVMDQLR

SEQ ID NO: 6136 - protein, 12 aa, Artificial Sequence
  Description of Artificial Sequence: Synthetic peptide
REALARLETLDT

SEQ ID NO: 6137 - protein, 12 aa, Artificial Sequence
  Description of Artificial Sequence: Synthetic peptide
KSLLKIINDYEE

SEQ ID NO: 6138 - protein, 12 aa, Artificial Sequence
  Description of Artificial Sequence: Synthetic peptide
INHAIRQAYEDK

SEQ ID NO: 6139 - protein, 12 aa, Artificial Sequence
  Description of Artificial Sequence: Synthetic peptide
EKAEKIKNLFNE

SEQ ID NO: 6140 - protein, 12 aa, Artificial Sequence
  Description of Artificial Sequence: Synthetic peptide
KHFRTREVAITQ

SEQ ID NO: 6141 - protein, 12 aa, Artificial Sequence
  Description of Artificial Sequence: Synthetic peptide
ISARIKEELLKN

SEQ ID NO: 6142 - protein, 12 aa, Artificial Sequence
  Description of Artificial Sequence: Synthetic peptide
SSLKDIDIAREN

SEQ ID NO: 6143 - protein, 12 aa, Artificial Sequence
  Description of Artificial Sequence: Synthetic peptide
TLKVLRHHQEKL

SEQ ID NO: 6144 - protein, 12 aa, Artificial Sequence
  Description of Artificial Sequence: Synthetic peptide
KEDIARKEQLKS

SEQ ID NO: 6145 - protein, 12 aa, Artificial Sequence
  Description of Artificial Sequence: Synthetic peptide
TLVKVKDAEDQL

SEQ ID NO: 6146 - protein, 13 aa, Artificial Sequence
  Description of Artificial Sequence: Synthetic peptide
GDLIRAIQETHDR

SEQ ID NO: 6147 - protein, 13 aa, Artificial Sequence
  Description of Artificial Sequence: Synthetic peptide
LDNMREVVERNRA

SEQ ID NO: 6148 - protein, 13 aa, Artificial Sequence
  Description of Artificial Sequence: Synthetic peptide
PHQEKLLKILAKT

SEQ ID NO: 6149 - protein, 13 aa, Artificial Sequence
  Description of Artificial Sequence: Synthetic peptide
KITQDAAEAIKKY

SEQ ID NO: 6150 - protein, 13 aa, Artificial Sequence
  Description of Artificial Sequence: Synthetic peptide
LEKTHELKEVLNK

SEQ ID NO: 6151 - protein, 13 aa, Artificial Sequence
  Description of Artificial Sequence: Synthetic peptide
DATKAANDALLKE

SEQ ID NO: 6152 - protein, 13 aa, Artificial Sequence
  Description of Artificial Sequence: Synthetic peptide
NGLEQAKKFHEAV

SEQ ID NO: 6153 - protein, 13 aa, Artificial Sequence
  Description of Artificial Sequence: Synthetic peptide
RSDVLDAAVTRKI

SEQ ID NO: 6154 - protein, 13 aa, Artificial Sequence
  Description of Artificial Sequence: Synthetic peptide
VVADSMQRHARKY

SEQ ID NO: 6155 - protein, 13 aa, Artificial Sequence
  Description of Artificial Sequence: Synthetic peptide
ESAVRVVERLNRQ

SEQ ID NO: 6156 - protein, 13 aa, Artificial Sequence
  Description of Artificial Sequence: Synthetic peptide
DRDTETLVHWIRK

SEQ ID NO: 6157 - protein, 13 aa, Artificial Sequence
  Description of Artificial Sequence: Synthetic peptide
TVLVHRVHSYLER

SEQ ID NO: 6158 - protein, 13 aa, Artificial Sequence
  Description of Artificial Sequence: Synthetic peptide
EEYLTSLGRKHRA

SEQ ID NO: 6159 - protein, 13 aa, Artificial Sequence
  Description of Artificial Sequence: Synthetic peptide
SYELERVVRQLEN

SEQ ID NO: 6160 - protein, 13 aa, Artificial Sequence
  Description of Artificial Sequence: Synthetic peptide
VNHLVDNTRKLEE

SEQ ID NO: 6161 - protein, 13 aa, Artificial Sequence
  Description of Artificial Sequence: Synthetic peptide
VEKAETLRKWLNE

SEQ ID NO: 6162 - protein, 13 aa, Artificial Sequence
  Description of Artificial Sequence: Synthetic peptide
QDKVVELVDIMQK

SEQ ID NO: 6163 - protein, 13 aa, Artificial Sequence
  Description of Artificial Sequence: Synthetic peptide
SIHRHTVVKLAHT

SEQ ID NO: 6164 - protein, 13 aa, Artificial Sequence
  Description of Artificial Sequence: Synthetic peptide
VTDVTTKAKQLKD

SEQ ID NO: 6165 - protein, 13 aa, Artificial Sequence
  Description of Artificial Sequence: Synthetic peptide
VDEVRKIFRQLAS

SEQ ID NO: 6166 - protein, 13 aa, Artificial Sequence
  Description of Artificial Sequence: Synthetic peptide
ETITLKKLEEWKN

SEQ ID NO: 6167 - protein, 13 aa, Artificial Sequence
  Description of Artificial Sequence: Synthetic peptide
LRKQLSLDVLDKL

SEQ ID NO: 6168 - protein, 13 aa, Artificial Sequence
  Description of Artificial Sequence: Synthetic peptide
EQADRIVKFAKAN

SEQ ID NO: 6169 - protein, 13 aa, Artificial Sequence
  Description of Artificial Sequence: Synthetic peptide
ADERAKINQIIFE

SEQ ID NO: 6170 - protein, 13 aa, Artificial Sequence
  Description of Artificial Sequence: Synthetic peptide
RYQKERIENVARE

SEQ ID NO: 6171 - protein, 13 aa, Artificial Sequence
  Description of Artificial Sequence: Synthetic peptide
KDSDDDLVYRSLK

SEQ ID NO: 6172 - protein, 13 aa, Artificial Sequence
  Description of Artificial Sequence: Synthetic peptide
PESVLKVAHHASE

SEQ ID NO: 6173 - protein, 13 aa, Artificial Sequence
  Description of Artificial Sequence: Synthetic peptide
KHEAQRLEQEARG

SEQ ID NO: 6174 - protein, 13 aa, Artificial Sequence
  Description of Artificial Sequence: Synthetic peptide
KHLVEQLIRDLKT

SEQ ID NO: 6175 - protein, 13 aa, Artificial Sequence
  Description of Artificial Sequence: Synthetic peptide
ENSLKTAQKVHTE

SEQ ID NO: 6176 - protein, 13 aa, Artificial Sequence
  Description of Artificial Sequence: Synthetic peptide
PRNNLKRILKEME

SEQ ID NO: 6177 - protein, 13 aa, Artificial Sequence
  Description of Artificial Sequence: Synthetic peptide
EDQINKLVELVKS

SEQ ID NO: 6178 - protein, 13 aa, Artificial Sequence
  Description of Artificial Sequence: Synthetic peptide
AQADLLNLKRKVD

SEQ ID NO: 6179 - protein, 13 aa, Artificial Sequence
  Description of Artificial Sequence: Synthetic peptide
DEQRKLLKEAQAE

SEQ ID NO: 6180 - protein, 13 aa, Artificial Sequence
  Description of Artificial Sequence: Synthetic peptide
MDITMFKEDLKSH

SEQ ID NO: 6181 - protein, 13 aa, Artificial Sequence
  Description of Artificial Sequence: Synthetic peptide
DGTIKKWQDIARK

SEQ ID NO: 6182 - protein, 13 aa, Artificial Sequence
  Description of Artificial Sequence: Synthetic peptide
VDRINDRLQAIDT

SEQ ID NO: 6183 - protein, 13 aa, Artificial Sequence
  Description of Artificial Sequence: Synthetic peptide
KDEVERKMKSLLN

SEQ ID NO: 6184 - protein, 13 aa, Artificial Sequence
  Description of Artificial Sequence: Synthetic peptide
VESLNRADREAQA

SEQ ID NO: 6185 - protein, 13 aa, Artificial Sequence
  Description of Artificial Sequence: Synthetic peptide
PTVRELKETLENS

SEQ ID NO: 6186 - protein, 13 aa, Artificial Sequence
  Description of Artificial Sequence: Synthetic peptide
PKELLDRATTLLE

SEQ ID NO: 6187 - protein, 13 aa, Artificial Sequence
  Description of Artificial Sequence: Synthetic peptide
EEALSKLLERIKQ

SEQ ID NO: 6188 - protein, 13 aa, Artificial Sequence
  Description of Artificial Sequence: Synthetic peptide
KTELIQKAKLAEQ

SEQ ID NO: 6189 - protein, 13 aa, Artificial Sequence
  Description of Artificial Sequence: Synthetic peptide
EKLNQLWEKAQRL

SEQ ID NO: 6190 - protein, 13 aa, Artificial Sequence
  Description of Artificial Sequence: Synthetic peptide
TKTIAIYDKLKEL

SEQ ID NO: 6191 - protein, 13 aa, Artificial Sequence
  Description of Artificial Sequence: Synthetic peptide
PDFRDELTQAAKK

SEQ ID NO: 6192 - protein, 13 aa, Artificial Sequence
  Description of Artificial Sequence: Synthetic peptide
LDFKKELEQKVKQ

SEQ ID NO: 6193 - protein, 13 aa, Artificial Sequence
  Description of Artificial Sequence: Synthetic peptide
VEVKSVVDFIQKH

SEQ ID NO: 6194 - protein, 13 aa, Artificial Sequence
  Description of Artificial Sequence: Synthetic peptide
NEIRKKIYQKISE

SEQ ID NO: 6195 - protein, 13 aa, Artificial Sequence
  Description of Artificial Sequence: Synthetic peptide
ISKVRHMQEWLET

SEQ ID NO: 6196 - protein, 13 aa, Artificial Sequence
  Description of Artificial Sequence: Synthetic peptide
EDVREKLQASLKN

SEQ ID NO: 6197 - protein, 13 aa, Artificial Sequence
  Description of Artificial Sequence: Synthetic peptide
PKDQEIKKLVDQN

SEQ ID NO: 6198 - protein, 13 aa, Artificial Sequence
  Description of Artificial Sequence: Synthetic peptide
DEHKLLFRVLTNL

SEQ ID NO: 6199 - protein, 13 aa, Artificial Sequence
  Description of Artificial Sequence: Synthetic peptide
TTKELIKKLAEIN

SEQ ID NO: 6200 - protein, 13 aa, Artificial Sequence
  Description of Artificial Sequence: Synthetic peptide
SEDVDIIFTRLKG

SEQ ID NO: 6201 - protein, 13 aa, Artificial Sequence
  Description of Artificial Sequence: Synthetic peptide
EDFVKALSDAKQR

SEQ ID NO: 6202 - protein, 13 aa, Artificial Sequence
  Description of Artificial Sequence: Synthetic peptide
MKETQEMLDFAAK

SEQ ID NO: 6203 - protein, 13 aa, Artificial Sequence
  Description of Artificial Sequence: Synthetic peptide
HLTRAVDRALARS

SEQ ID NO: 6204 - protein, 13 aa, Artificial Sequence
  Description of Artificial Sequence: Synthetic peptide
ETTLKRLGATHLR

SEQ ID NO: 6205 - protein, 13 aa, Artificial Sequence
  Description of Artificial Sequence: Synthetic peptide
HSKYREEAMQNRI

SEQ ID NO: 6206 - protein, 13 aa, Artificial Sequence
  Description of Artificial Sequence: Synthetic peptide
EAARQDAQQYRKT

SEQ ID NO: 6207 - protein, 13 aa, Artificial Sequence
  Description of Artificial Sequence: Synthetic peptide
DTTLKRLGATHLK

SEQ ID NO: 6208 - protein, 13 aa, Artificial Sequence
  Description of Artificial Sequence: Synthetic peptide
YQKEIVDKHNALR

SEQ ID NO: 6209 - protein, 13 aa, Artificial Sequence
  Description of Artificial Sequence: Synthetic peptide
HTQVIELERKFSH

SEQ ID NO: 6210 - protein, 13 aa, Artificial Sequence
  Description of Artificial Sequence: Synthetic peptide
DAERERFRNLTQE

SEQ ID NO: 6211 - protein, 13 aa, Artificial Sequence
  Description of Artificial Sequence: Synthetic peptide
KVQLKELEREYAT

SEQ ID NO: 6212 - protein, 13 aa, Artificial Sequence
  Description of Artificial Sequence: Synthetic peptide
PEQKKVNQVLKEF

SEQ ID NO: 6213 - protein, 13 aa, Artificial Sequence
  Description of Artificial Sequence: Synthetic peptide
EKIIKEFIQKTLT

SEQ ID NO: 6214 - protein, 13 aa, Artificial Sequence
  Description of Artificial Sequence: Synthetic peptide
HKTIDRFIALTKT

SEQ ID NO: 6215 - protein, 13 aa, Artificial Sequence
  Description of Artificial Sequence: Synthetic peptide
ALKDEALKTFVEQ

SEQ ID NO: 6216 - protein, 13 aa, Artificial Sequence
  Description of Artificial Sequence: Synthetic peptide
PKLTEALKEQVEK

SEQ ID NO: 6217 - protein, 13 aa, Artificial Sequence
  Description of Artificial Sequence: Synthetic peptide
KAVEQVKSDFNKL

SEQ ID NO: 6218 - protein, 13 aa, Artificial Sequence
  Description of Artificial Sequence: Synthetic peptide
VESLRKLVDHLIN

SEQ ID NO: 6219 - protein, 13 aa, Artificial Sequence
  Description of Artificial Sequence: Synthetic peptide
DQDSNRLSDALTK

SEQ ID NO: 6220 - protein, 13 aa, Artificial Sequence
  Description of Artificial Sequence: Synthetic peptide
KEMYNEIIRVLKN

SEQ ID NO: 6221 - protein, 13 aa, Artificial Sequence
  Description of Artificial Sequence: Synthetic peptide
DGDLRATIQALHH

SEQ ID NO: 6222 - protein, 13 aa, Artificial Sequence
  Description of Artificial Sequence: Synthetic peptide
VEMKSEFLATKAK

SEQ ID NO: 6223 - protein, 13 aa, Artificial Sequence
  Description of Artificial Sequence: Synthetic peptide
AETLMDRIKKQLR

SEQ ID NO: 6224 - protein, 13 aa, Artificial Sequence
  Description of Artificial Sequence: Synthetic peptide
AALETHAQALRER

SEQ ID NO: 6225 - protein, 13 aa, Artificial Sequence
  Description of Artificial Sequence: Synthetic peptide
REKRVSNAVEFLL

SEQ ID NO: 6226 - protein, 13 aa, Artificial Sequence
  Description of Artificial Sequence: Synthetic peptide
RELTSLLKELLEM

SEQ ID NO: 6227 - protein, 13 aa, Artificial Sequence
  Description of Artificial Sequence: Synthetic peptide
THEAVHLTAHAKE

SEQ ID NO: 6228 - protein, 13 aa, Artificial Sequence
  Description of Artificial Sequence: Synthetic peptide
LDELQLFTDAIRK

SEQ ID NO: 6229 - protein, 13 aa, Artificial Sequence
  Description of Artificial Sequence: Synthetic peptide
RDSLGALSKALKE

SEQ ID NO: 6230 - protein, 13 aa, Artificial Sequence
  Description of Artificial Sequence: Synthetic peptide
SDERAAVYRAIET

SEQ ID NO: 6231 - protein, 13 aa, Artificial Sequence
  Description of Artificial Sequence: Synthetic peptide
SKGAQDLARAIKD

SEQ ID NO: 6232 - protein, 13 aa, Artificial Sequence
  Description of Artificial Sequence: Synthetic peptide
DEIRNEAHQLLKL

SEQ ID NO: 6233 - protein, 13 aa, Artificial Sequence
  Description of Artificial Sequence: Synthetic peptide
PRTNERIFELLLR

SEQ ID NO: 6234 - protein, 13 aa, Artificial Sequence
  Description of Artificial Sequence: Synthetic peptide
LKEAVELAKFTTD

SEQ ID NO: 6235 - protein, 13 aa, Artificial Sequence
  Description of Artificial Sequence: Synthetic peptide
HSLNVKLVKELAK

SEQ ID NO: 6236 - protein, 13 aa, Artificial Sequence
  Description of Artificial Sequence: Synthetic peptide
HKNVMRMVNHEVS

SEQ ID NO: 6237 - protein, 13 aa, Artificial Sequence
  Description of Artificial Sequence: Synthetic peptide
PENAIKRADELIS

SEQ ID NO: 6238 - protein, 13 aa, Artificial Sequence
  Description of Artificial Sequence: Synthetic peptide
LKQFKNDLKHVLQ

SEQ ID NO: 6239 - protein, 13 aa, Artificial Sequence
  Description of Artificial Sequence: Synthetic peptide
QRVISHVEAEAKI

SEQ ID NO: 6240 - protein, 13 aa, Artificial Sequence
  Description of Artificial Sequence: Synthetic peptide
TDKLRGEALDLQH

SEQ ID NO: 6241 - protein, 13 aa, Artificial Sequence
  Description of Artificial Sequence: Synthetic peptide
DRVNEAAQFARSK

SEQ ID NO: 6242 - protein, 13 aa, Artificial Sequence
  Description of Artificial Sequence: Synthetic peptide
SWEARALLHTLEH

SEQ ID NO: 6243 - protein, 13 aa, Artificial Sequence
  Description of Artificial Sequence: Synthetic peptide
HTTVRNALKDLLK

SEQ ID NO: 6244 - protein, 13 aa, Artificial Sequence
  Description of Artificial Sequence: Synthetic peptide
WDDQQKVKKTAEA

SEQ ID NO: 6245 - protein, 13 aa, Artificial Sequence
  Description of Artificial Sequence: Synthetic peptide
EKAYRQVNELLHN

SEQ ID NO: 6246 - protein, 13 aa, Artificial Sequence
  Description of Artificial Sequence: Synthetic peptide
EEDKVAVKAAVQN

SEQ ID NO: 6247 - protein, 13 aa, Artificial Sequence
  Description of Artificial Sequence: Synthetic peptide
HHTASESFMKHMQ

SEQ ID NO: 6248 - protein, 13 aa, Artificial Sequence
  Description of Artificial Sequence: Synthetic peptide
SAQVQKEEQLKID

SEQ ID NO: 6249 - protein, 13 aa, Artificial Sequence
  Description of Artificial Sequence: Synthetic peptide
LSDTVRVNRKMRD

SEQ ID NO: 6250 - protein, 13 aa, Artificial Sequence
  Description of Artificial Sequence: Synthetic peptide
LDDARALTTRAKA

SEQ ID NO: 6251 - protein, 13 aa, Artificial Sequence
  Description of Artificial Sequence: Synthetic peptide
AVQKESDEYILAK

SEQ ID NO: 6252 - protein, 13 aa, Artificial Sequence
  Description of Artificial Sequence: Synthetic peptide
AVERTRELFAKSL

SEQ ID NO: 6253 - protein, 13 aa, Artificial Sequence
  Description of Artificial Sequence: Synthetic peptide
DTRNRLLAQFADK

SEQ ID NO: 6254 - protein, 13 aa, Artificial Sequence
  Description of Artificial Sequence: Synthetic peptide
EFAKVIVQKLKDN

SEQ ID NO: 6255 - protein, 13 aa, Artificial Sequence
  Description of Artificial Sequence: Synthetic peptide
ERYVEQLKQALKT

SEQ ID NO: 6256 - protein, 13 aa, Artificial Sequence
  Description of Artificial Sequence: Synthetic peptide
LKDKLLHKQFASH

SEQ ID NO: 6257 - protein, 13 aa, Artificial Sequence
  Description of Artificial Sequence: Synthetic peptide
KKSYDEIAEKLND

SEQ ID NO: 6258 - protein, 13 aa, Artificial Sequence
  Description of Artificial Sequence: Synthetic peptide
DNEKNEFQLVLNK

SEQ ID NO: 6259 - protein, 13 aa, Artificial Sequence
  Description of Artificial Sequence: Synthetic peptide
QEAIQAAIKKVED

SEQ ID NO: 6260 - protein, 13 aa, Artificial Sequence
  Description of Artificial Sequence: Synthetic peptide
EKLTSQIYEETVK

SEQ ID NO: 6261 - protein, 13 aa, Artificial Sequence
  Description of Artificial Sequence: Synthetic peptide
HDVHTLVLGREIT

SEQ ID NO: 6262 - protein, 13 aa, Artificial Sequence
  Description of Artificial Sequence: Synthetic peptide
QDLRKKIVDLHKS

SEQ ID NO: 6263 - protein, 13 aa, Artificial Sequence
  Description of Artificial Sequence: Synthetic peptide
EHVRKVFDEIQQK

SEQ ID NO: 6264 - protein, 13 aa, Artificial Sequence
  Description of Artificial Sequence: Synthetic peptide
KEQLAELKVSYLK

SEQ ID NO: 6265 - protein, 13 aa, Artificial Sequence
  Description of Artificial Sequence: Synthetic peptide
NWPKTLKLALEKE

SEQ ID NO: 6266 - protein, 13 aa, Artificial Sequence
  Description of Artificial Sequence: Synthetic peptide
THGSRMDFIVKEL

SEQ ID NO: 6267 - protein, 13 aa, Artificial Sequence
  Description of Artificial Sequence: Synthetic peptide
LTEFTNEKDTLSK

SEQ ID NO: 6268 - protein, 13 aa, Artificial Sequence
  Description of Artificial Sequence: Synthetic peptide
LNYVKEKLEEVHS

SEQ ID NO: 6269 - protein, 13 aa, Artificial Sequence
  Description of Artificial Sequence: Synthetic peptide
VEGVWTLKDEIKT

SEQ ID NO: 6270 - protein, 13 aa, Artificial Sequence
  Description of Artificial Sequence: Synthetic peptide
NEDVARTKKIIQR

SEQ ID NO: 6271 - protein, 13 aa, Artificial Sequence
  Description of Artificial Sequence: Synthetic peptide
AETKKLLDIVARS

SEQ ID NO: 6272 - protein, 13 aa, Artificial Sequence
  Description of Artificial Sequence: Synthetic peptide
DYILKSLLESAEK

SEQ ID NO: 6273 - protein, 13 aa, Artificial Sequence
  Description of Artificial Sequence: Synthetic peptide
DRIGTHMINSAEK

SEQ ID NO: 6274 - protein, 13 aa, Artificial Sequence
  Description of Artificial Sequence: Synthetic peptide
SEDVVVSKVGRDL

SEQ ID NO: 6275 - protein, 13 aa, Artificial Sequence
  Description of Artificial Sequence: Synthetic peptide
HSETVAKHGAKLS

SEQ ID NO: 6276 - protein, 13 aa, Artificial Sequence
  Description of Artificial Sequence: Synthetic peptide
LDSTLEAVRKAKD

SEQ ID NO: 6277 - protein, 13 aa, Artificial Sequence
  Description of Artificial Sequence: Synthetic peptide
VESNLDVVRQKLE

SEQ ID NO: 6278 - protein, 13 aa, Artificial Sequence
  Description of Artificial Sequence: Synthetic peptide
ERNTEKVRDYLES

SEQ ID NO: 6279 - protein, 13 aa, Artificial Sequence
  Description of Artificial Sequence: Synthetic peptide
NDRLIATLKSMRD

SEQ ID NO: 6280 - protein, 13 aa, Artificial Sequence
  Description of Artificial Sequence: Synthetic peptide
KSTNRDYLAERLR

SEQ ID NO: 6281 - protein, 13 aa, Artificial Sequence
  Description of Artificial Sequence: Synthetic peptide
REEWKGGAETNKI

SEQ ID NO: 6282 - protein, 13 aa, Artificial Sequence
  Description of Artificial Sequence: Synthetic peptide
SAAIHRLVDTSEK

SEQ ID NO: 6283 - protein, 13 aa, Artificial Sequence
  Description of Artificial Sequence: Synthetic peptide
PKAGDEFVEKTLS

SEQ ID NO: 6284 - protein, 13 aa, Artificial Sequence
  Description of Artificial Sequence: Synthetic peptide
TPRKRLKESLDQI

SEQ ID NO: 6285 - protein, 13 aa, Artificial Sequence
  Description of Artificial Sequence: Synthetic peptide
EHSAKSLRLLLAE

SEQ ID NO: 6286 - protein, 13 aa, Artificial Sequence
  Description of Artificial Sequence: Synthetic peptide
QEFREAIRKALLT

SEQ ID NO: 6287 - protein, 13 aa, Artificial Sequence
  Description of Artificial Sequence: Synthetic peptide
TKDAEKVVSEIKA

SEQ ID NO: 6288 - protein, 13 aa, Artificial Sequence
  Description of Artificial Sequence: Synthetic peptide
LEGLKDITREVAS

SEQ ID NO: 6289 - protein, 13 aa, Artificial Sequence
  Description of Artificial Sequence: Synthetic peptide
VTDRIVRTLHDLS

SEQ ID NO: 6290 - protein, 13 aa, Artificial Sequence
  Description of Artificial Sequence: Synthetic peptide
DSKLVDKIANEIS

SEQ ID NO: 6291 - protein, 13 aa, Artificial Sequence
  Description of Artificial Sequence: Synthetic peptide
EGHLSLMRLARQH

SEQ ID NO: 6292 - protein, 13 aa, Artificial Sequence
  Description of Artificial Sequence: Synthetic peptide
QEYVRETIDKLMA

SEQ ID NO: 6293 - protein, 13 aa, Artificial Sequence
  Description of Artificial Sequence: Synthetic peptide
PTRKEEVVRALNN

SEQ ID NO: 6294 - protein, 13 aa, Artificial Sequence
  Description of Artificial Sequence: Synthetic peptide
SAIKDELIKTLDG

SEQ ID NO: 6295 - protein, 13 aa, Artificial Sequence
  Description of Artificial Sequence: Synthetic peptide
RDVDTTMELLKRL

SEQ ID NO: 6296 - protein, 13 aa, Artificial Sequence
  Description of Artificial Sequence: Synthetic peptide
VDTTRHVDVLHAW

SEQ ID NO: 6297 - protein, 13 aa, Artificial Sequence
  Description of Artificial Sequence: Synthetic peptide
EKLKETVVKAVSI

SEQ ID NO: 6298 - protein, 13 aa, Artificial Sequence
  Description of Artificial Sequence: Synthetic peptide
KSRLSHQITRMEN

SEQ ID NO: 6299 - protein, 13 aa, Artificial Sequence
  Description of Artificial Sequence: Synthetic peptide
SRLEDAVKKTVAE

SEQ ID NO: 6300 - protein, 13 aa, Artificial Sequence
  Description of Artificial Sequence: Synthetic peptide
SVDTLAKLAREKL

SEQ ID NO: 6301 - protein, 13 aa, Artificial Sequence
  Description of Artificial Sequence: Synthetic peptide
DADKTRYTALIIK

SEQ ID NO: 6302 - protein, 13 aa, Artificial Sequence
  Description of Artificial Sequence: Synthetic peptide
PEQVIAEAIRKKT

SEQ ID NO: 6303 - protein, 13 aa, Artificial Sequence
  Description of Artificial Sequence: Synthetic peptide
ETTLKRLGASHSK

SEQ ID NO: 6304 - protein, 13 aa, Artificial Sequence
  Description of Artificial Sequence: Synthetic peptide
DTSNRLKQIMAER

SEQ ID NO: 6305 - protein, 13 aa, Artificial Sequence
  Description of Artificial Sequence: Synthetic peptide
TSDVIKDLMERIK

SEQ ID NO: 6306 - protein, 13 aa, Artificial Sequence
  Description of Artificial Sequence: Synthetic peptide
PRQLKEIQDFVKE

SEQ ID NO: 6307 - protein, 13 aa, Artificial Sequence
  Description of Artificial Sequence: Synthetic peptide
EKAAQKVVSEVEA

SEQ ID NO: 6308 - protein, 13 aa, Artificial Sequence
  Description of Artificial Sequence: Synthetic peptide
TTGVHRLYQMEKD

SEQ ID NO: 6309 - protein, 13 aa, Artificial Sequence
  Description of Artificial Sequence: Synthetic peptide
DRTQTVLRDIRDA

SEQ ID NO: 6310 - protein, 13 aa, Artificial Sequence
  Description of Artificial Sequence: Synthetic peptide
DAQKEKYLPKLAT

SEQ ID NO: 6311 - protein, 13 aa, Artificial Sequence
  Description of Artificial Sequence: Synthetic peptide
QHGSRFIQQKLER

SEQ ID NO: 6312 - protein, 13 aa, Artificial Sequence
  Description of Artificial Sequence: Synthetic peptide
EADYIERTVSKVM

SEQ ID NO: 6313 - protein, 13 aa, Artificial Sequence
  Description of Artificial Sequence: Synthetic peptide
LDKMQQFVTKLHR

SEQ ID NO: 6314 - protein, 13 aa, Artificial Sequence
  Description of Artificial Sequence: Synthetic peptide
DLKTIKKTLQELL

SEQ ID NO: 6315 - protein, 13 aa, Artificial Sequence
  Description of Artificial Sequence: Synthetic peptide
RETVNKALADFAH

SEQ ID NO: 6316 - protein, 13 aa, Artificial Sequence
  Description of Artificial Sequence: Synthetic peptide
WDQLLDNVAKLKK

SEQ ID NO: 6317 - protein, 13 aa, Artificial Sequence
  Description of Artificial Sequence: Synthetic peptide
DVPEALNRTLKDL

SEQ ID NO: 6318 - protein, 13 aa, Artificial Sequence
  Description of Artificial Sequence: Synthetic peptide
EKVADRLKFQLGQ

SEQ ID NO: 6319 - protein, 13 aa, Artificial Sequence
  Description of Artificial Sequence: Synthetic peptide
STEVELSMKLREY

SEQ ID NO: 6320 - protein, 13 aa, Artificial Sequence
  Description of Artificial Sequence: Synthetic peptide
PDLHLNRATLHKY

SEQ ID NO: 6321 - protein, 13 aa, Artificial Sequence
  Description of Artificial Sequence: Synthetic peptide
SLEAKAIVDKTMD

SEQ ID NO: 6322 - protein, 13 aa, Artificial Sequence
  Description of Artificial Sequence: Synthetic peptide
EHGKSIVEHSKKI

SEQ ID NO: 6323 - protein, 13 aa, Artificial Sequence
  Description of Artificial Sequence: Synthetic peptide
AQDFRKSMELARE

SEQ ID NO: 6324 - protein, 13 aa, Artificial Sequence
  Description of Artificial Sequence: Synthetic peptide
EQDVNAAHDRLAR

SEQ ID NO: 6325 - protein, 13 aa, Artificial Sequence
  Description of Artificial Sequence: Synthetic peptide
TDQKVSEAKRAMQ

SEQ ID NO: 6326 - protein, 13 aa, Artificial Sequence
  Description of Artificial Sequence: Synthetic peptide
VSTVQRSVKKLHE

SEQ ID NO: 6327 - protein, 13 aa, Artificial Sequence
  Description of Artificial Sequence: Synthetic peptide
TEKTLKLVKQAEK

SEQ ID NO: 6328 - protein, 13 aa, Artificial Sequence
  Description of Artificial Sequence: Synthetic peptide
EKTVELLRNVLKE

SEQ ID NO: 6329 - protein, 13 aa, Artificial Sequence
  Description of Artificial Sequence: Synthetic peptide
IDEARQELHRIIN

SEQ ID NO: 6330 - protein, 13 aa, Artificial Sequence
  Description of Artificial Sequence: Synthetic peptide
RDAQAVQRQRVAD

SEQ ID NO: 6331 - protein, 13 aa, Artificial Sequence
  Description of Artificial Sequence: Synthetic peptide
TREKLNRILSERT

SEQ ID NO: 6332 - protein, 13 aa, Artificial Sequence
  Description of Artificial Sequence: Synthetic peptide
IFASRTLIDRLKE

SEQ ID NO: 6333 - protein, 13 aa, Artificial Sequence
  Description of Artificial Sequence: Synthetic peptide
ADAHSNLASIHKD

SEQ ID NO: 6334 - protein, 13 aa, Artificial Sequence
  Description of Artificial Sequence: Synthetic peptide
RQEYEDIAVKLGT

SEQ ID NO: 6335 - protein, 13 aa, Artificial Sequence
  Description of Artificial Sequence: Synthetic peptide
HHAWHRLLDQALN

SEQ ID NO: 6336 - protein, 13 aa, Artificial Sequence
  Description of Artificial Sequence: Synthetic peptide
KSYKELVTLSAEE

SEQ ID NO: 6337 - protein, 13 aa, Artificial Sequence
  Description of Artificial Sequence: Synthetic peptide
PSRDRLLAHLGTE

SEQ ID NO: 6338 - protein, 13 aa, Artificial Sequence
  Description of Artificial Sequence: Synthetic peptide
TEKAWEVLTKARA

SEQ ID NO: 6339 - protein, 13 aa, Artificial Sequence
  Description of Artificial Sequence: Synthetic peptide
EYRKKLMDGLTNQ

SEQ ID NO: 6340 - protein, 13 aa, Artificial Sequence
  Description of Artificial Sequence: Synthetic peptide
KDKLKNLIWIHEN

SEQ ID NO: 6341 - protein, 13 aa, Artificial Sequence
  Description of Artificial Sequence: Synthetic peptide
EQYREPLRNALKD

SEQ ID NO: 6342 - protein, 13 aa, Artificial Sequence
  Description of Artificial Sequence: Synthetic peptide
NEEKSYKIPRVNS

SEQ ID NO: 6343 - protein, 13 aa, Artificial Sequence
  Description of Artificial Sequence: Synthetic peptide
ESNLKRLGAIHFK

SEQ ID NO: 6344 - protein, 13 aa, Artificial Sequence
  Description of Artificial Sequence: Synthetic peptide
EQLARKAEAQAKK

SEQ ID NO: 6345 - protein, 13 aa, Artificial Sequence
  Description of Artificial Sequence: Synthetic peptide
MGHAEKIASELKT

SEQ ID NO: 6346 - protein, 13 aa, Artificial Sequence
  Description of Artificial Sequence: Synthetic peptide
QEDTFAAELHRLK

SEQ ID NO: 6347 - protein, 13 aa, Artificial Sequence
  Description of Artificial Sequence: Synthetic peptide
LETNLRKLFDKLL

SEQ ID NO: 6348 - protein, 13 aa, Artificial Sequence
  Description of Artificial Sequence: Synthetic peptide
IKETQEMVDFSIK

SEQ ID NO: 6349 - protein, 13 aa, Artificial Sequence
  Description of Artificial Sequence: Synthetic peptide
ESTLYPILKKLEK

SEQ ID NO: 6350 - protein, 13 aa, Artificial Sequence
  Description of Artificial Sequence: Synthetic peptide
LKEVETSLSRFEQ

SEQ ID NO: 6351 - protein, 13 aa, Artificial Sequence
  Description of Artificial Sequence: Synthetic peptide
EQVAKEAQKILTK

SEQ ID NO: 6352 - protein, 13 aa, Artificial Sequence
  Description of Artificial Sequence: Synthetic peptide
EKEGLEVLSAIRN

SEQ ID NO: 6353 - protein, 13 aa, Artificial Sequence
  Description of Artificial Sequence: Synthetic peptide
ERVKETLRTVKKD

SEQ ID NO: 6354 - protein, 13 aa, Artificial Sequence
  Description of Artificial Sequence: Synthetic peptide
ESGQKELQIRYEK

SEQ ID NO: 6355 - protein, 13 aa, Artificial Sequence
  Description of Artificial Sequence: Synthetic peptide
EKSLRTMDRLVRA

SEQ ID NO: 6356 - protein, 13 aa, Artificial Sequence
  Description of Artificial Sequence: Synthetic peptide
QKDRDIFVKKAES

SEQ ID NO: 6357 - protein, 13 aa, Artificial Sequence
  Description of Artificial Sequence: Synthetic peptide
AKELAELANRAES

SEQ ID NO: 6358 - protein, 13 aa, Artificial Sequence
  Description of Artificial Sequence: Synthetic peptide
TSTILREVELLKK

SEQ ID NO: 6359 - protein, 13 aa, Artificial Sequence
  Description of Artificial Sequence: Synthetic peptide
QDERDIAATVRQF

SEQ ID NO: 6360 - protein, 13 aa, Artificial Sequence
  Description of Artificial Sequence: Synthetic peptide
RTAHNAREKLAES

SEQ ID NO: 6361 - protein, 13 aa, Artificial Sequence
  Description of Artificial Sequence: Synthetic peptide
VKEAKQIVKDWKS

SEQ ID NO: 6362 - protein, 13 aa, Artificial Sequence
  Description of Artificial Sequence: Synthetic peptide
DTTKKIIDEALYH

SEQ ID NO: 6363 - protein, 13 aa, Artificial Sequence
  Description of Artificial Sequence: Synthetic peptide
TSEAVELAKHAEK

SEQ ID NO: 6364 - protein, 13 aa, Artificial Sequence
  Description of Artificial Sequence: Synthetic peptide
YEVKRARELNQLL

SEQ ID NO: 6365 - protein, 13 aa, Artificial Sequence
  Description of Artificial Sequence: Synthetic peptide
SEVKAYETKVAVE

SEQ ID NO: 6366 - protein, 13 aa, Artificial Sequence
  Description of Artificial Sequence: Synthetic peptide
VWALDSEVKSLHR

SEQ ID NO: 6367 - protein, 13 aa, Artificial Sequence
  Description of Artificial Sequence: Synthetic peptide
EENRKAFEKALET

SEQ ID NO: 6368 - protein, 13 aa, Artificial Sequence
  Description of Artificial Sequence: Synthetic peptide
DQIVNNKVKKGLE

SEQ ID NO: 6369 - protein, 13 aa, Artificial Sequence
  Description of Artificial Sequence: Synthetic peptide
DGLIAERQKLLDS

SEQ ID NO: 6370 - protein, 13 aa, Artificial Sequence
  Description of Artificial Sequence: Synthetic peptide
QTHAKRAYRELVL

SEQ ID NO: 6371 - protein, 13 aa, Artificial Sequence
  Description of Artificial Sequence: Synthetic peptide
PQEKLKTVKENWK

SEQ ID NO: 6372 - protein, 13 aa, Artificial Sequence
  Description of Artificial Sequence: Synthetic peptide
SEKFLNDLVDSMK

SEQ ID NO: 6373 - protein, 13 aa, Artificial Sequence
  Description of Artificial Sequence: Synthetic peptide
PANFEAQMKHLKD

SEQ ID NO: 6374 - protein, 13 aa, Artificial Sequence
  Description of Artificial Sequence: Synthetic peptide
HGESLRVHALAES

SEQ ID NO: 6375 - protein, 13 aa, Artificial Sequence
  Description of Artificial Sequence: Synthetic peptide
RETVTKVIGELAR

SEQ ID NO: 6376 - protein, 13 aa, Artificial Sequence
  Description of Artificial Sequence: Synthetic peptide
LADFRQTIDKVDA

SEQ ID NO: 6377 - protein, 13 aa, Artificial Sequence
  Description of Artificial Sequence: Synthetic peptide
KPEIRALNELADS

SEQ ID NO: 6378 - protein, 13 aa, Artificial Sequence
  Description of Artificial Sequence: Synthetic peptide
RADVKSVMDSLIR

SEQ ID NO: 6379 - protein, 13 aa, Artificial Sequence
  Description of Artificial Sequence: Synthetic peptide
QRRIKKVTHDMDM

SEQ ID NO: 6380 - protein, 13 aa, Artificial Sequence
  Description of Artificial Sequence: Synthetic peptide
RELVKKVSDVIWN

SEQ ID NO: 6381 - protein, 13 aa, Artificial Sequence
  Description of Artificial Sequence: Synthetic peptide
VQTLRERLIDALE

SEQ ID NO: 6382 - protein, 13 aa, Artificial Sequence
  Description of Artificial Sequence: Synthetic peptide
DVRTERLRDRITQ

SEQ ID NO: 6383 - protein, 13 aa, Artificial Sequence
  Description of Artificial Sequence: Synthetic peptide
LSTAQKIIKEARD

SEQ ID NO: 6384 - protein, 13 aa, Artificial Sequence
  Description of Artificial Sequence: Synthetic peptide
EVSSRVVHAIKEA

SEQ ID NO: 6385 - protein, 13 aa, Artificial Sequence
  Description of Artificial Sequence: Synthetic peptide
SRVSRFADLSKEV

SEQ ID NO: 6386 - protein, 13 aa, Artificial Sequence
  Description of Artificial Sequence: Synthetic peptide
EKVESEIKKVENF

SEQ ID NO: 6387 - protein, 13 aa, Artificial Sequence
  Description of Artificial Sequence: Synthetic peptide
EDRLNQIVQELRG

SEQ ID NO: 6388 - protein, 13 aa, Artificial Sequence
  Description of Artificial Sequence: Synthetic peptide
RIRDEVFKVLQQH

SEQ ID NO: 6389 - protein, 13 aa, Artificial Sequence
  Description of Artificial Sequence: Synthetic peptide
PATVDRTHALMRK

SEQ ID NO: 6390 - protein, 13 aa, Artificial Sequence
  Description of Artificial Sequence: Synthetic peptide
SKVIIDRVTEYLE

SEQ ID NO: 6391 - protein, 13 aa, Artificial Sequence
  Description of Artificial Sequence: Synthetic peptide
KSAKSLKPLFDEL

SEQ ID NO: 6392 - protein, 13 aa, Artificial Sequence
  Description of Artificial Sequence: Synthetic peptide
VDKRNETTLKLIK

SEQ ID NO: 6393 - protein, 13 aa, Artificial Sequence
  Description of Artificial Sequence: Synthetic peptide
KETLLADMRQAER

SEQ ID NO: 6394 - protein, 13 aa, Artificial Sequence
  Description of Artificial Sequence: Synthetic peptide
MDIQARIKFETEG

SEQ ID NO: 6395 - protein, 13 aa, Artificial Sequence
  Description of Artificial Sequence: Synthetic peptide
VKSYDEIIKKLSD

SEQ ID NO: 6396 - protein, 13 aa, Artificial Sequence
  Description of Artificial Sequence: Synthetic peptide
KDTVEKVRQTFEN

SEQ ID NO: 6397 - protein, 13 aa, Artificial Sequence
  Description of Artificial Sequence: Synthetic peptide
DEVSTKILMEFNK

SEQ ID NO: 6398 - protein, 13 aa, Artificial Sequence
  Description of Artificial Sequence: Synthetic peptide
FDTVADKIHSVSR

SEQ ID NO: 6399 - protein, 13 aa, Artificial Sequence
  Description of Artificial Sequence: Synthetic peptide
ENVLEAARHLHQT

SEQ ID NO: 6400 - protein, 13 aa, Artificial Sequence
  Description of Artificial Sequence: Synthetic peptide
RDKVNDIVDQVIT

SEQ ID NO: 6401 - protein, 13 aa, Artificial Sequence
  Description of Artificial Sequence: Synthetic peptide
RERVASLLKERLT

SEQ ID NO: 6402 - protein, 13 aa, Artificial Sequence
  Description of Artificial Sequence: Synthetic peptide
VDKRNETTLRLIK

SEQ ID NO: 6403 - protein, 13 aa, Artificial Sequence
  Description of Artificial Sequence: Synthetic peptide
ESLVEKVKEFLST

SEQ ID NO: 6404 - protein, 13 aa, Artificial Sequence
  Description of Artificial Sequence: Synthetic peptide
PDKVKEFAQRITA

SEQ ID NO: 6405 - protein, 13 aa, Artificial Sequence
  Description of Artificial Sequence: Synthetic peptide
GEANVKKEIQLLR

SEQ ID NO: 6406 - protein, 13 aa, Artificial Sequence
  Description of Artificial Sequence: Synthetic peptide
RMREQLNFLAEEL

SEQ ID NO: 6407 - protein, 13 aa, Artificial Sequence
  Description of Artificial Sequence: Synthetic peptide
EKTLRDKLVLATE

SEQ ID NO: 6408 - protein, 13 aa, Artificial Sequence
  Description of Artificial Sequence: Synthetic peptide
PDATAETKALLHR

SEQ ID NO: 6409 - protein, 13 aa, Artificial Sequence
  Description of Artificial Sequence: Synthetic peptide
ESAVTDFAARLRE

SEQ ID NO: 6410 - protein, 13 aa, Artificial Sequence
  Description of Artificial Sequence: Synthetic peptide
ITKHMERYLDILN

SEQ ID NO: 6411 - protein, 13 aa, Artificial Sequence
  Description of Artificial Sequence: Synthetic peptide
QEFREAIRKALVS

SEQ ID NO: 6412 - protein, 13 aa, Artificial Sequence
  Description of Artificial Sequence: Synthetic peptide
DNKLNEIGEKYKK

SEQ ID NO: 6413 - protein, 13 aa, Artificial Sequence
  Description of Artificial Sequence: Synthetic peptide
RVTVTRLLGDLRE

SEQ ID NO: 6414 - protein, 13 aa, Artificial Sequence
  Description of Artificial Sequence: Synthetic peptide
AQRLHEIRTQLVE

SEQ ID NO: 6415 - protein, 13 aa, Artificial Sequence
  Description of Artificial Sequence: Synthetic peptide
GLDRKEVQQLTVK

SEQ ID NO: 6416 - protein, 13 aa, Artificial Sequence
  Description of Artificial Sequence: Synthetic peptide
TIDKVSDIVKEKL

SEQ ID NO: 6417 - protein, 13 aa, Artificial Sequence
  Description of Artificial Sequence: Synthetic peptide
AVLKDRVSRNSAD

SEQ ID NO: 6418 - protein, 13 aa, Artificial Sequence
  Description of Artificial Sequence: Synthetic peptide
PKARQEVDHHWQA

SEQ ID NO: 6419 - protein, 13 aa, Artificial Sequence
  Description of Artificial Sequence: Synthetic peptide
KAHSIRLRALAQE

SEQ ID NO: 6420 - protein, 13 aa, Artificial Sequence
  Description of Artificial Sequence: Synthetic peptide
TAMLKDTTELLKK

SEQ ID NO: 6421 - protein, 13 aa, Artificial Sequence
  Description of Artificial Sequence: Synthetic peptide
KDMKKAVMAFQDQ

SEQ ID NO: 6422 - protein, 13 aa, Artificial Sequence
  Description of Artificial Sequence: Synthetic peptide
TSLIKLVKDKIRE

SEQ ID NO: 6423 - protein, 13 aa, Artificial Sequence
  Description of Artificial Sequence: Synthetic peptide
KDVQKTLQNDVDN

SEQ ID NO: 6424 - protein, 13 aa, Artificial Sequence
  Description of Artificial Sequence: Synthetic peptide
TVSLTKKIKEAVD

SEQ ID NO: 6425 - protein, 13 aa, Artificial Sequence
  Description of Artificial Sequence: Synthetic peptide
DSDINRGIAKALK

SEQ ID NO: 6426 - protein, 13 aa, Artificial Sequence
  Description of Artificial Sequence: Synthetic peptide
GEELSHLKKALTI

SEQ ID NO: 6427 - protein, 13 aa, Artificial Sequence
  Description of Artificial Sequence: Synthetic peptide
NEDFVRLSTEARK

SEQ ID NO: 6428 - protein, 13 aa, Artificial Sequence
  Description of Artificial Sequence: Synthetic peptide
DDIVEQQKPIAIK

SEQ ID NO: 6429 - protein, 13 aa, Artificial Sequence
  Description of Artificial Sequence: Synthetic peptide
EVITSAMAKKAHE

SEQ ID NO: 6430 - protein, 13 aa, Artificial Sequence
  Description of Artificial Sequence: Synthetic peptide
SDLVDQGKERLNR

SEQ ID NO: 6431 - protein, 13 aa, Artificial Sequence
  Description of Artificial Sequence: Synthetic peptide
SHREMTSKLLSDL

SEQ ID NO: 6432 - protein, 13 aa, Artificial Sequence
  Description of Artificial Sequence: Synthetic peptide
LAELKSYHQAHKA

SEQ ID NO: 6433 - protein, 13 aa, Artificial Sequence
  Description of Artificial Sequence: Synthetic peptide
KTKSVAEIIRDEF

SEQ ID NO: 6434 - protein, 13 aa, Artificial Sequence
  Description of Artificial Sequence: Synthetic peptide
SLTHAFKLLDKID

SEQ ID NO: 6435 - protein, 13 aa, Artificial Sequence
  Description of Artificial Sequence: Synthetic peptide
ASQVEKDSDLNQK

SEQ ID NO: 6436 - protein, 13 aa, Artificial Sequence
  Description of Artificial Sequence: Synthetic peptide
EAETRATVQKYKT

SEQ ID NO: 6437 - protein, 13 aa, Artificial Sequence
  Description of Artificial Sequence: Synthetic peptide
DTVYKKLVQREKT

SEQ ID NO: 6438 - protein, 13 aa, Artificial Sequence
  Description of Artificial Sequence: Synthetic peptide
KESLEALDAAKTA

SEQ ID NO: 6439 - protein, 13 aa, Artificial Sequence
  Description of Artificial Sequence: Synthetic peptide
RETVRQALRELLI

SEQ ID NO: 6440 - protein, 13 aa, Artificial Sequence
  Description of Artificial Sequence: Synthetic peptide
VQKDLERLTQERI

SEQ ID NO: 6441 - protein, 13 aa, Artificial Sequence
  Description of Artificial Sequence: Synthetic peptide
TTDVEKSFDKLLK

SEQ ID NO: 6442 - protein, 13 aa, Artificial Sequence
  Description of Artificial Sequence: Synthetic peptide
DRALTAAVKISER

SEQ ID NO: 6443 - protein, 13 aa, Artificial Sequence
  Description of Artificial Sequence: Synthetic peptide
VEFVKHELNRLLS

SEQ ID NO: 6444 - protein, 13 aa, Artificial Sequence
  Description of Artificial Sequence: Synthetic peptide
TAKDIAEAQKMLD

SEQ ID NO: 6445 - protein, 13 aa, Artificial Sequence
  Description of Artificial Sequence: Synthetic peptide
PEDVLKTAIKTVE

SEQ ID NO: 6446 - protein, 13 aa, Artificial Sequence
  Description of Artificial Sequence: Synthetic peptide
QEVEVAKSIAEKL

SEQ ID NO: 6447 - protein, 13 aa, Artificial Sequence
  Description of Artificial Sequence: Synthetic peptide
RETVSRVLHALAE

SEQ ID NO: 6448 - protein, 13 aa, Artificial Sequence
  Description of Artificial Sequence: Synthetic peptide
LKDISIIISHFDK

SEQ ID NO: 6449 - protein, 13 aa, Artificial Sequence
  Description of Artificial Sequence: Synthetic peptide
QATVQKIRDAIRD

SEQ ID NO: 6450 - protein, 13 aa, Artificial Sequence
  Description of Artificial Sequence: Synthetic peptide
AEKVDAINDVLRS

SEQ ID NO: 6451 - protein, 13 aa, Artificial Sequence
  Description of Artificial Sequence: Synthetic peptide
ADIRKEVEQIDKS

SEQ ID NO: 6452 - protein, 13 aa, Artificial Sequence
  Description of Artificial Sequence: Synthetic peptide
LKSHQVRLVLAEK

SEQ ID NO: 6453 - protein, 13 aa, Artificial Sequence
  Description of Artificial Sequence: Synthetic peptide
DADILSWANRKVR

SEQ ID NO: 6454 - protein, 13 aa, Artificial Sequence
  Description of Artificial Sequence: Synthetic peptide
QETIKHVKDLIAE

SEQ ID NO: 6455 - protein, 13 aa, Artificial Sequence
  Description of Artificial Sequence: Synthetic peptide
EKIQKEAQEALEK

SEQ ID NO: 6456 - protein, 13 aa, Artificial Sequence
  Description of Artificial Sequence: Synthetic peptide
EARVRNQFLKEMD

SEQ ID NO: 6457 - protein, 13 aa, Artificial Sequence
  Description of Artificial Sequence: Synthetic peptide
EKAILNVTKEWKK

SEQ ID NO: 6458 - protein, 13 aa, Artificial Sequence
  Description of Artificial Sequence: Synthetic peptide
HSQYREEALLNRL

SEQ ID NO: 6459 - protein, 13 aa, Artificial Sequence
  Description of Artificial Sequence: Synthetic peptide
IPDAERILKTLET

SEQ ID NO: 6460 - protein, 13 aa, Artificial Sequence
  Description of Artificial Sequence: Synthetic peptide
TEKSKELAEIVVQ

SEQ ID NO: 6461 - protein, 13 aa, Artificial Sequence
  Description of Artificial Sequence: Synthetic peptide
RKDRDTARQLHEV

SEQ ID NO: 6462 - protein, 13 aa, Artificial Sequence
  Description of Artificial Sequence: Synthetic peptide
VKEQEWSMAVERG

SEQ ID NO: 6463 - protein, 13 aa, Artificial Sequence
  Description of Artificial Sequence: Synthetic peptide
TRTRLSFEKAARE

SEQ ID NO: 6464 - protein, 13 aa, Artificial Sequence
  Description of Artificial Sequence: Synthetic peptide
RKSADKALEVYKS

SEQ ID NO: 6465 - protein, 13 aa, Artificial Sequence
  Description of Artificial Sequence: Synthetic peptide
FNTLKNNMKDIHD

SEQ ID NO: 6466 - protein, 13 aa, Artificial Sequence
  Description of Artificial Sequence: Synthetic peptide
DAHSIRLRALAQE

SEQ ID NO: 6467 - protein, 13 aa, Artificial Sequence
  Description of Artificial Sequence: Synthetic peptide
DATRERIKSAATR

SEQ ID NO: 6468 - protein, 13 aa, Artificial Sequence
  Description of Artificial Sequence: Synthetic peptide
SKAKDRVMDIART

SEQ ID NO: 6469 - protein, 13 aa, Artificial Sequence
  Description of Artificial Sequence: Synthetic peptide
SEMALKWITKGEK

SEQ ID NO: 6470 - protein, 13 aa, Artificial Sequence
  Description of Artificial Sequence: Synthetic peptide
ITRDSVIRIAKDL

SEQ ID NO: 6471 - protein, 13 aa, Artificial Sequence
  Description of Artificial Sequence: Synthetic peptide
ENEVGVAIQEKLR

SEQ ID NO: 6472 - protein, 13 aa, Artificial Sequence
  Description of Artificial Sequence: Synthetic peptide
DNVTKDVFADLNR

SEQ ID NO: 6473 - protein, 13 aa, Artificial Sequence
  Description of Artificial Sequence: Synthetic peptide
KTLKKIAEKVESE

SEQ ID NO: 6474 - protein, 13 aa, Artificial Sequence
  Description of Artificial Sequence: Synthetic peptide
MKETQEMIDFAAK

SEQ ID NO: 6475 - protein, 13 aa, Artificial Sequence
  Description of Artificial Sequence: Synthetic peptide
EAQKEKYLPKLIS

SEQ ID NO: 6476 - protein, 13 aa, Artificial Sequence
  Description of Artificial Sequence: Synthetic peptide
VQEGVDKIRHFQE

SEQ ID NO: 6477 - protein, 13 aa, Artificial Sequence
  Description of Artificial Sequence: Synthetic peptide
QMLEKNAREAVKE

SEQ ID NO: 6478 - protein, 13 aa, Artificial Sequence
  Description of Artificial Sequence: Synthetic peptide
RAEVVQQLEKELF

SEQ ID NO: 6479 - protein, 13 aa, Artificial Sequence
  Description of Artificial Sequence: Synthetic peptide
DKERSIISDIFSH

SEQ ID NO: 6480 - protein, 13 aa, Artificial Sequence
  Description of Artificial Sequence: Synthetic peptide
DRNDLITYLKKAT

SEQ ID NO: 6481 - protein, 13 aa, Artificial Sequence
  Description of Artificial Sequence: Synthetic peptide
DQQKKKYLGRMTE

SEQ ID NO: 6482 - protein, 13 aa, Artificial Sequence
  Description of Artificial Sequence: Synthetic peptide
AEADKAIQRYESL

SEQ ID NO: 6483 - protein, 13 aa, Artificial Sequence
  Description of Artificial Sequence: Synthetic peptide
KANREKMTQIMFE

SEQ ID NO: 6484 - protein, 13 aa, Artificial Sequence
  Description of Artificial Sequence: Synthetic peptide
RKITDDLVKNVEK

SEQ ID NO: 6485 - protein, 13 aa, Artificial Sequence
  Description of Artificial Sequence: Synthetic peptide
MIGEETKAQILDK

SEQ ID NO: 6486 - protein, 13 aa, Artificial Sequence
  Description of Artificial Sequence: Synthetic peptide
EQIAKEALKVLTK

SEQ ID NO: 6487 - protein, 13 aa, Artificial Sequence
  Description of Artificial Sequence: Synthetic peptide
EKLVKNLFQLARE

SEQ ID NO: 6488 - protein, 13 aa, Artificial Sequence
  Description of Artificial Sequence: Synthetic peptide
RQALGEAREVIKN

SEQ ID NO: 6489 - protein, 13 aa, Artificial Sequence
  Description of Artificial Sequence: Synthetic peptide
QVTKDAAEAIKKH

SEQ ID NO: 6490 - protein, 13 aa, Artificial Sequence
  Description of Artificial Sequence: Synthetic peptide
NEQVAEKVKVAID

SEQ ID NO: 6491 - protein, 13 aa, Artificial Sequence
  Description of Artificial Sequence: Synthetic peptide
YDKTTEVIIRDIR

SEQ ID NO: 6492 - protein, 13 aa, Artificial Sequence
  Description of Artificial Sequence: Synthetic peptide
SDEVRKNLMDMFR

SEQ ID NO: 6493 - protein, 13 aa, Artificial Sequence
  Description of Artificial Sequence: Synthetic peptide
VETGKKVVELSEK

SEQ ID NO: 6494 - protein, 13 aa, Artificial Sequence
  Description of Artificial Sequence: Synthetic peptide
RKNVEYLEKLRES

SEQ ID NO: 6495 - protein, 13 aa, Artificial Sequence
  Description of Artificial Sequence: Synthetic peptide
LLRETKVGVEVNK

SEQ ID NO: 6496 - protein, 13 aa, Artificial Sequence
  Description of Artificial Sequence: Synthetic peptide
PRTREVLKEWIAS

SEQ ID NO: 6497 - protein, 13 aa, Artificial Sequence
  Description of Artificial Sequence: Synthetic peptide
SKAVKEAYENAQK

SEQ ID NO: 6498 - protein, 13 aa, Artificial Sequence
  Description of Artificial Sequence: Synthetic peptide
MESKARLLSLVKD

SEQ ID NO: 6499 - protein, 13 aa, Artificial Sequence
  Description of Artificial Sequence: Synthetic peptide
EETRNAVWAAIKE

SEQ ID NO: 6500 - protein, 13 aa, Artificial Sequence
  Description of Artificial Sequence: Synthetic peptide
QHGSRFIQLKLER

SEQ ID NO: 6501 - protein, 13 aa, Artificial Sequence
  Description of Artificial Sequence: Synthetic peptide
DERMAQFTARLNE

SEQ ID NO: 6502 - protein, 13 aa, Artificial Sequence
  Description of Artificial Sequence: Synthetic peptide
EHVQRLLLSSREA

SEQ ID NO: 6503 - protein, 13 aa, Artificial Sequence
  Description of Artificial Sequence: Synthetic peptide
KNELVQKAKLAEQ

SEQ ID NO: 6504 - protein, 13 aa, Artificial Sequence
  Description of Artificial Sequence: Synthetic peptide
AADRDGLRAQWQR

SEQ ID NO: 6505 - protein, 13 aa, Artificial Sequence
  Description of Artificial Sequence: Synthetic peptide
DRIGFSMISDAEK

SEQ ID NO: 6506 - protein, 13 aa, Artificial Sequence
  Description of Artificial Sequence: Synthetic peptide
DEDVREKLQASLK

SEQ ID NO: 6507 - protein, 13 aa, Artificial Sequence
  Description of Artificial Sequence: Synthetic peptide
KENKKFLLDLMLN

SEQ ID NO: 6508 - protein, 13 aa, Artificial Sequence
  Description of Artificial Sequence: Synthetic peptide
VKELEAYTDAIQR

SEQ ID NO: 6509 - protein, 13 aa, Artificial Sequence
  Description of Artificial Sequence: Synthetic peptide
KAKIDPILEARQN

SEQ ID NO: 6510 - protein, 13 aa, Artificial Sequence
  Description of Artificial Sequence: Synthetic peptide
WESAEKVVKTLLK

SEQ ID NO: 6511 - protein, 13 aa, Artificial Sequence
  Description of Artificial Sequence: Synthetic peptide
IQEIDKAIKKAAQ

SEQ ID NO: 6512 - protein, 13 aa, Artificial Sequence
  Description of Artificial Sequence: Synthetic peptide
AETIKELARLFES

SEQ ID NO: 6513 - protein, 13 aa, Artificial Sequence
  Description of Artificial Sequence: Synthetic peptide
PTKFAEIVEENLK

SEQ ID NO: 6514 - protein, 13 aa, Artificial Sequence
  Description of Artificial Sequence: Synthetic peptide
TDIVEAVAERLQR

SEQ ID NO: 6515 - protein, 13 aa, Artificial Sequence
  Description of Artificial Sequence: Synthetic peptide
SKEIVTLVEDFHR

SEQ ID NO: 6516 - protein, 13 aa, Artificial Sequence
  Description of Artificial Sequence: Synthetic peptide
DSGRETVRAALKH

SEQ ID NO: 6517 - protein, 13 aa, Artificial Sequence
  Description of Artificial Sequence: Synthetic peptide
KADLREAIQTMLD

SEQ ID NO: 6518 - protein, 13 aa, Artificial Sequence
  Description of Artificial Sequence: Synthetic peptide
TLELTRQVKEKLA

SEQ ID NO: 6519 - protein, 13 aa, Artificial Sequence
  Description of Artificial Sequence: Synthetic peptide
KQYLELMQKVLDE

SEQ ID NO: 6520 - protein, 13 aa, Artificial Sequence
  Description of Artificial Sequence: Synthetic peptide
LDLTKILSKKYKE

SEQ ID NO: 6521 - protein, 13 aa, Artificial Sequence
  Description of Artificial Sequence: Synthetic peptide
VDQAKRIADELIS

SEQ ID NO: 6522 - protein, 13 aa, Artificial Sequence
  Description of Artificial Sequence: Synthetic peptide
AAQIKKLKEAIDS

SEQ ID NO: 6523 - protein, 13 aa, Artificial Sequence
  Description of Artificial Sequence: Synthetic peptide
EKEAKDSAITFIQ

SEQ ID NO: 6524 - protein, 13 aa, Artificial Sequence
  Description of Artificial Sequence: Synthetic peptide
DAQRQATKDAGRI

SEQ ID NO: 6525 - protein, 13 aa, Artificial Sequence
  Description of Artificial Sequence: Synthetic peptide
KQQFLKVLKEAES

SEQ ID NO: 6526 - protein, 13 aa, Artificial Sequence
  Description of Artificial Sequence: Synthetic peptide
TLKVLRHHQEKLE

SEQ ID NO: 6527 - protein, 13 aa, Artificial Sequence
  Description of Artificial Sequence: Synthetic peptide
TKIAEKIDEFLAT

SEQ ID NO: 6528 - protein, 13 aa, Artificial Sequence
  Description of Artificial Sequence: Synthetic peptide
EKLALDLLEQIKN

SEQ ID NO: 6529 - protein, 13 aa, Artificial Sequence
  Description of Artificial Sequence: Synthetic peptide
DIFNKNLRAHALE

SEQ ID NO: 6530 - protein, 13 aa, Artificial Sequence
  Description of Artificial Sequence: Synthetic peptide
IQEIVDKVKPQLE

SEQ ID NO: 6531 - protein, 13 aa, Artificial Sequence
  Description of Artificial Sequence: Synthetic peptide
MKQYLKTKLLEEV

SEQ ID NO: 6532 - protein, 13 aa, Artificial Sequence
  Description of Artificial Sequence: Synthetic peptide
LEELFSKIKNTLK

SEQ ID NO: 6533 - protein, 13 aa, Artificial Sequence
  Description of Artificial Sequence: Synthetic peptide
RDEVLAQLEKSLK

SEQ ID NO: 6534 - protein, 13 aa, Artificial Sequence
  Description of Artificial Sequence: Synthetic peptide
QETRKKTMVDLET

SEQ ID NO: 6535 - protein, 13 aa, Artificial Sequence
  Description of Artificial Sequence: Synthetic peptide
TWVRDVVRSMDRK

SEQ ID NO: 6536 - protein, 13 aa, Artificial Sequence
  Description of Artificial Sequence: Synthetic peptide
DIFNKNMRAHALE

SEQ ID NO: 6537 - protein, 13 aa, Artificial Sequence
  Description of Artificial Sequence: Synthetic peptide
LRKTADDFLNRIA

SEQ ID NO: 6538 - protein, 13 aa, Artificial Sequence
  Description of Artificial Sequence: Synthetic peptide
FDVKIAEQISKET

SEQ ID NO: 6539 - protein, 13 aa, Artificial Sequence
  Description of Artificial Sequence: Synthetic peptide
EALIRKASEISIK

SEQ ID NO: 6540 - protein, 13 aa, Artificial Sequence
  Description of Artificial Sequence: Synthetic peptide
DAKARDVVNRLTA

SEQ ID NO: 6541 - protein, 13 aa, Artificial Sequence
  Description of Artificial Sequence: Synthetic peptide
MDQVMKAHELYQK

SEQ ID NO: 6542 - protein, 13 aa, Artificial Sequence
  Description of Artificial Sequence: Synthetic peptide
PSGTFVREKIRES

SEQ ID NO: 6543 - protein, 13 aa, Artificial Sequence
  Description of Artificial Sequence: Synthetic peptide
LEKVREQVQAAHA

SEQ ID NO: 6544 - protein, 13 aa, Artificial Sequence
  Description of Artificial Sequence: Synthetic peptide
RPRVEQITAELLD

SEQ ID NO: 6545 - protein, 13 aa, Artificial Sequence
  Description of Artificial Sequence: Synthetic peptide
RDLASRIVSTQHH

SEQ ID NO: 6546 - protein, 13 aa, Artificial Sequence
  Description of Artificial Sequence: Synthetic peptide
TSLMERVTEYAEK

SEQ ID NO: 6547 - protein, 13 aa, Artificial Sequence
  Description of Artificial Sequence: Synthetic peptide
QENKKKTVVDFET

SEQ ID NO: 6548 - protein, 13 aa, Artificial Sequence
  Description of Artificial Sequence: Synthetic peptide
LKEISDLIKKELT

SEQ ID NO: 6549 - protein, 13 aa, Artificial Sequence
  Description of Artificial Sequence: Synthetic peptide
RKSLGELIHTLDG

SEQ ID NO: 6550 - protein, 13 aa, Artificial Sequence
  Description of Artificial Sequence: Synthetic peptide
TASVDKKYAELVD

SEQ ID NO: 6551 - protein, 13 aa, Artificial Sequence
  Description of Artificial Sequence: Synthetic peptide
AQELKQLIDTAKE

SEQ ID NO: 6552 - protein, 13 aa, Artificial Sequence
  Description of Artificial Sequence: Synthetic peptide
DDKLEQIRKDYTS

SEQ ID NO: 6553 - protein, 13 aa, Artificial Sequence
  Description of Artificial Sequence: Synthetic peptide
FKQLVEDLDRILT

SEQ ID NO: 6554 - protein, 13 aa, Artificial Sequence
  Description of Artificial Sequence: Synthetic peptide
PRQKEALAKFREN

SEQ ID NO: 6555 - protein, 13 aa, Artificial Sequence
  Description of Artificial Sequence: Synthetic peptide
AATLEEKLNKIFE

SEQ ID NO: 6556 - protein, 13 aa, Artificial Sequence
  Description of Artificial Sequence: Synthetic peptide
KKSLTEIKDVLAS

SEQ ID NO: 6557 - protein, 13 aa, Artificial Sequence
  Description of Artificial Sequence: Synthetic peptide
QKDLKDWVEALNQ

SEQ ID NO: 6558 - protein, 13 aa, Artificial Sequence
  Description of Artificial Sequence: Synthetic peptide
ETTRLWREVVTEV

SEQ ID NO: 6559 - protein, 13 aa, Artificial Sequence
  Description of Artificial Sequence: Synthetic peptide
KDATNEAIRDWIT

SEQ ID NO: 6560 - protein, 13 aa, Artificial Sequence
  Description of Artificial Sequence: Synthetic peptide
YDDIKAAMKTASE

SEQ ID NO: 6561 - protein, 13 aa, Artificial Sequence
  Description of Artificial Sequence: Synthetic peptide
EKVIKWAEQNAAE

SEQ ID NO: 6562 - protein, 13 aa, Artificial Sequence
  Description of Artificial Sequence: Synthetic peptide
KEEDQRVIKLVQK

SEQ ID NO: 6563 - protein, 13 aa, Artificial Sequence
  Description of Artificial Sequence: Synthetic peptide
EEQVDKINQRLKE

SEQ ID NO: 6564 - protein, 13 aa, Artificial Sequence
  Description of Artificial Sequence: Synthetic peptide
VDEALKDAQTRIT

SEQ ID NO: 6565 - protein, 13 aa, Artificial Sequence
  Description of Artificial Sequence: Synthetic peptide
NETRAYVLDRMKE

SEQ ID NO: 6566 - protein, 13 aa, Artificial Sequence
  Description of Artificial Sequence: Synthetic peptide
KEELVRLIQTAHA

SEQ ID NO: 6567 - protein, 13 aa, Artificial Sequence
  Description of Artificial Sequence: Synthetic peptide
EAEKTGAQELLRV

SEQ ID NO: 6568 - protein, 13 aa, Artificial Sequence
  Description of Artificial Sequence: Synthetic peptide
LEDLKLTTDLLLK

SEQ ID NO: 6569 - protein, 13 aa, Artificial Sequence
  Description of Artificial Sequence: Synthetic peptide
PEFQANEVRKVKK

SEQ ID NO: 6570 - protein, 13 aa, Artificial Sequence
  Description of Artificial Sequence: Synthetic peptide
RADLEATLRKITD

SEQ ID NO: 6571 - protein, 13 aa, Artificial Sequence
  Description of Artificial Sequence: Synthetic peptide
PRAIETAKENAKL

SEQ ID NO: 6572 - protein, 13 aa, Artificial Sequence
  Description of Artificial Sequence: Synthetic peptide
QEALSVARAFDEK

SEQ ID NO: 6573 - protein, 13 aa, Artificial Sequence
  Description of Artificial Sequence: Synthetic peptide
KDRNDLITYLKKA

SEQ ID NO: 6574 - protein, 13 aa, Artificial Sequence
  Description of Artificial Sequence: Synthetic peptide
RETLLTMAERARA

SEQ ID NO: 6575 - protein, 13 aa, Artificial Sequence
  Description of Artificial Sequence: Synthetic peptide
ETTRLALKALARH

SEQ ID NO: 6576 - protein, 13 aa, Artificial Sequence
  Description of Artificial Sequence: Synthetic peptide
IPSKYRDELTAKL

SEQ ID NO: 6577 - protein, 13 aa, Artificial Sequence
  Description of Artificial Sequence: Synthetic peptide
AKVSEALEKRYSM

SEQ ID NO: 6578 - protein, 13 aa, Artificial Sequence
  Description of Artificial Sequence: Synthetic peptide
ISDTVKRAREAFN

SEQ ID NO: 6579 - protein, 13 aa, Artificial Sequence
  Description of Artificial Sequence: Synthetic peptide
SDDRKKHLLIREQ

SEQ ID NO: 6580 - protein, 13 aa, Artificial Sequence
  Description of Artificial Sequence: Synthetic peptide
TSTISALERVKKE

SEQ ID NO: 6581 - protein, 13 aa, Artificial Sequence
  Description of Artificial Sequence: Synthetic peptide
THASIDLTKKATE

SEQ ID NO: 6582 - protein, 13 aa, Artificial Sequence
  Description of Artificial Sequence: Synthetic peptide
ETRINIVKLTEKI

SEQ ID NO: 6583 - protein, 13 aa, Artificial Sequence
  Description of Artificial Sequence: Synthetic peptide
KQRIVEEVTRLLK

SEQ ID NO: 6584 - protein, 13 aa, Artificial Sequence
  Description of Artificial Sequence: Synthetic peptide
SEDAKGLIKSAIR

SEQ ID NO: 6585 - protein, 13 aa, Artificial Sequence
  Description of Artificial Sequence: Synthetic peptide
VRDERNVIRAASN

SEQ ID NO: 6586 - protein, 13 aa, Artificial Sequence
  Description of Artificial Sequence: Synthetic peptide
PRDVETLLQGMRD

SEQ ID NO: 6587 - protein, 13 aa, Artificial Sequence
  Description of Artificial Sequence: Synthetic peptide
AKDRVDLQFGVEQ

SEQ ID NO: 6588 - protein, 13 aa, Artificial Sequence
  Description of Artificial Sequence: Synthetic peptide
TDGTGHIRAIKES

SEQ ID NO: 6589 - protein, 13 aa, Artificial Sequence
  Description of Artificial Sequence: Synthetic peptide
QESVKSKVQYLKD

SEQ ID NO: 6590 - protein, 13 aa, Artificial Sequence
  Description of Artificial Sequence: Synthetic peptide
EQLLRKAEAQAKK

SEQ ID NO: 6591 - protein, 13 aa, Artificial Sequence
  Description of Artificial Sequence: Synthetic peptide
VENVTELKKNFNR

SEQ ID NO: 6592 - protein, 13 aa, Artificial Sequence
  Description of Artificial Sequence: Synthetic peptide
MRQVEALVEASKE

SEQ ID NO: 6593 - protein, 13 aa, Artificial Sequence
  Description of Artificial Sequence: Synthetic peptide
RDHLENFVKSLEA

SEQ ID NO: 6594 - protein, 13 aa, Artificial Sequence
  Description of Artificial Sequence: Synthetic peptide
QKEIDRLNEVAKN

SEQ ID NO: 6595 - protein, 13 aa, Artificial Sequence
  Description of Artificial Sequence: Synthetic peptide
LDEIISRAKKAET

SEQ ID NO: 6596 - protein, 13 aa, Artificial Sequence
  Description of Artificial Sequence: Synthetic peptide
LEKLTQDVLDIAR

SEQ ID NO: 6597 - protein, 13 aa, Artificial Sequence
  Description of Artificial Sequence: Synthetic peptide
DKLISETAKSVMK

SEQ ID NO: 6598 - protein, 13 aa, Artificial Sequence
  Description of Artificial Sequence: Synthetic peptide
QRVEAMFHTLDKI

SEQ ID NO: 6599 - protein, 13 aa, Artificial Sequence
  Description of Artificial Sequence: Synthetic peptide
VTESIDAHLLAKK

SEQ ID NO: 6600 - protein, 13 aa, Artificial Sequence
  Description of Artificial Sequence: Synthetic peptide
EGLYDQIMRVKND

SEQ ID NO: 6601 - protein, 13 aa, Artificial Sequence
  Description of Artificial Sequence: Synthetic peptide
NREIREINRVYKE

SEQ ID NO: 6602 - protein, 13 aa, Artificial Sequence
  Description of Artificial Sequence: Synthetic peptide
LNVLERKLSEFDK

SEQ ID NO: 6603 - protein, 13 aa, Artificial Sequence
  Description of Artificial Sequence: Synthetic peptide
MRERIEFLNEASV

SEQ ID NO: 6604 - protein, 13 aa, Artificial Sequence
  Description of Artificial Sequence: Synthetic peptide
EQHLRKAEAQAKK

SEQ ID NO: 6605 - protein, 13 aa, Artificial Sequence
  Description of Artificial Sequence: Synthetic peptide
VEVKSIVDFIKSH

SEQ ID NO: 6606 - protein, 13 aa, Artificial Sequence
  Description of Artificial Sequence: Synthetic peptide
VEVKSIVDFVKNH

SEQ ID NO: 6607 - protein, 14 aa, Artificial Sequence
  Description of Artificial Sequence: Synthetic peptide
GTHSKEREVWKEAL

SEQ ID NO: 6608 - protein, 14 aa, Artificial Sequence
  Description of Artificial Sequence: Synthetic peptide
NGKNRVKQWDTLVD

SEQ ID NO: 6609 - protein, 14 aa, Artificial Sequence
  Description of Artificial Sequence: Synthetic peptide
EKLKIKAQSYLDAI

SEQ ID NO: 6610 - protein, 14 aa, Artificial Sequence
  Description of Artificial Sequence: Synthetic peptide
PEQVIAEAIRKKTR

SEQ ID NO: 6611 - protein, 14 aa, Artificial Sequence
  Description of Artificial Sequence: Synthetic peptide
RDKVNDIVDQVITI

SEQ ID NO: 6612 - protein, 14 aa, Artificial Sequence
  Description of Artificial Sequence: Synthetic peptide
EAEKTAAQELLKVL

SEQ ID NO: 6613 - protein, 14 aa, Artificial Sequence
  Description of Artificial Sequence: Synthetic peptide
RHVAEREIATLAGS

SEQ ID NO: 6614 - protein, 14 aa, Artificial Sequence
  Description of Artificial Sequence: Synthetic peptide
NQDELKKLAATEAA

SEQ ID NO: 6615 - protein, 14 aa, Artificial Sequence
  Description of Artificial Sequence: Synthetic peptide
LMDNARVVDQLMKD

SEQ ID NO: 6616 - protein, 14 aa, Artificial Sequence
  Description of Artificial Sequence: Synthetic peptide
THLQVMAKERFHAG

SEQ ID NO: 6617 - protein, 14 aa, Artificial Sequence
  Description of Artificial Sequence: Synthetic peptide
ELSNRIREHGRNIA

SEQ ID NO: 6618 - protein, 14 aa, Artificial Sequence
  Description of Artificial Sequence: Synthetic peptide
NVRELKNVIERAVL

SEQ ID NO: 6619 - protein, 14 aa, Artificial Sequence
  Description of Artificial Sequence: Synthetic peptide
PTRDVVQRALAELE

SEQ ID NO: 6620 - protein, 14 aa, Artificial Sequence
  Description of Artificial Sequence: Synthetic peptide
NERNEALLKRINGR

SEQ ID NO: 6621 - protein, 14 aa, Artificial Sequence
  Description of Artificial Sequence: Synthetic peptide
REELTAVMRFLTQR

SEQ ID NO: 6622 - protein, 14 aa, Artificial Sequence
  Description of Artificial Sequence: Synthetic peptide
QERAKELAENASFI

SEQ ID NO: 6623 - protein, 14 aa, Artificial Sequence
  Description of Artificial Sequence: Synthetic peptide
YRGKIEKAVDLTSS

SEQ ID NO: 6624 - protein, 14 aa, Artificial Sequence
  Description of Artificial Sequence: Synthetic peptide
RQHNFEVAKELLET

SEQ ID NO: 6625 - protein, 14 aa, Artificial Sequence
  Description of Artificial Sequence: Synthetic peptide
DPVNQHVISEGLKK

SEQ ID NO: 6626 - protein, 14 aa, Artificial Sequence
  Description of Artificial Sequence: Synthetic peptide
FRDLALRVDQIRDN

SEQ ID NO: 6627 - protein, 14 aa, Artificial Sequence
  Description of Artificial Sequence: Synthetic peptide
EKLLDKAQRIVTNS

SEQ ID NO: 6628 - protein, 14 aa, Artificial Sequence
  Description of Artificial Sequence: Synthetic peptide
HQAMRAAGDEFETR

SEQ ID NO: 6629 - protein, 14 aa, Artificial Sequence
  Description of Artificial Sequence: Synthetic peptide
RKTMLELVEKVAEQ

SEQ ID NO: 6630 - protein, 14 aa, Artificial Sequence
  Description of Artificial Sequence: Synthetic peptide
RLENDIIRLINRTV

SEQ ID NO: 6631 - protein, 14 aa, Artificial Sequence
  Description of Artificial Sequence: Synthetic peptide
LSDFKELLRTVKAT

SEQ ID NO: 6632 - protein, 14 aa, Artificial Sequence
  Description of Artificial Sequence: Synthetic peptide
EDEVKTLLELKTKY

SEQ ID NO: 6633 - protein, 14 aa, Artificial Sequence
  Description of Artificial Sequence: Synthetic peptide
AQITEAIDGVRERL

SEQ ID NO: 6634 - protein, 14 aa, Artificial Sequence
  Description of Artificial Sequence: Synthetic peptide
QNRFDSLITELGKE

SEQ ID NO: 6635 - protein, 14 aa, Artificial Sequence
  Description of Artificial Sequence: Synthetic peptide
PDKIEKILSTLVKG

SEQ ID NO: 6636 - protein, 14 aa, Artificial Sequence
  Description of Artificial Sequence: Synthetic peptide
PDIRERFTKSRDAT

SEQ ID NO: 6637 - protein, 14 aa, Artificial Sequence
  Description of Artificial Sequence: Synthetic peptide
LRDRIKSKVDEQFD

SEQ ID NO: 6638 - protein, 14 aa, Artificial Sequence
  Description of Artificial Sequence: Synthetic peptide
QRDRLRSYRLLAEA

SEQ ID NO: 6639 - protein, 14 aa, Artificial Sequence
  Description of Artificial Sequence: Synthetic peptide
LDEAIQLAKALEKN

SEQ ID NO: 6640 - protein, 14 aa, Artificial Sequence
  Description of Artificial Sequence: Synthetic peptide
EEYLTSLGRKHRAV

SEQ ID NO: 6641 - protein, 14 aa, Artificial Sequence
  Description of Artificial Sequence: Synthetic peptide
LKSTQTVIHKALEK

SEQ ID NO: 6642 - protein, 14 aa, Artificial Sequence
  Description of Artificial Sequence: Synthetic peptide
EKSFKALMHLVSNE

SEQ ID NO: 6643 - protein, 14 aa, Artificial Sequence
  Description of Artificial Sequence: Synthetic peptide
MKEVDEQMLNVQNK

SEQ ID NO: 6644 - protein, 14 aa, Artificial Sequence
  Description of Artificial Sequence: Synthetic peptide
TVEMLVKVISEHKN

SEQ ID NO: 6645 - protein, 14 aa, Artificial Sequence
  Description of Artificial Sequence: Synthetic peptide
ADEVVKVANWAKDN

SEQ ID NO: 6646 - protein, 14 aa, Artificial Sequence
  Description of Artificial Sequence: Synthetic peptide
GDTHKRIWDAVASA

SEQ ID NO: 6647 - protein, 14 aa, Artificial Sequence
  Description of Artificial Sequence: Synthetic peptide
NSELIRLSMVLKEK

SEQ ID NO: 6648 - protein, 14 aa, Artificial Sequence
  Description of Artificial Sequence: Synthetic peptide
PEDKVKAVTKLNQH

SEQ ID NO: 6649 - protein, 14 aa, Artificial Sequence
  Description of Artificial Sequence: Synthetic peptide
KEGKATVEALINKY

SEQ ID NO: 6650 - protein, 14 aa, Artificial Sequence
  Description of Artificial Sequence: Synthetic peptide
DDEKNVAIAKYSQL

SEQ ID NO: 6651 - protein, 14 aa, Artificial Sequence
  Description of Artificial Sequence: Synthetic peptide
PTTDALEKKLAVLE

SEQ ID NO: 6652 - protein, 14 aa, Artificial Sequence
  Description of Artificial Sequence: Synthetic peptide
REVLAEKVKNAVNN

SEQ ID NO: 6653 - protein, 14 aa, Artificial Sequence
  Description of Artificial Sequence: Synthetic peptide
QTVDRLHFIKRMQE

SEQ ID NO: 6654 - protein, 14 aa, Artificial Sequence
  Description of Artificial Sequence: Synthetic peptide
ERQVRIQLKDHIDR

SEQ ID NO: 6655 - protein, 14 aa, Artificial Sequence
  Description of Artificial Sequence: Synthetic peptide
KETIDKVSDIVKEK

SEQ ID NO: 6656 - protein, 14 aa, Artificial Sequence
  Description of Artificial Sequence: Synthetic peptide
VDDTSDVIDALRKR

SEQ ID NO: 6657 - protein, 14 aa, Artificial Sequence
  Description of Artificial Sequence: Synthetic peptide
AASIDAVFETLEKK

SEQ ID NO: 6658 - protein, 14 aa, Artificial Sequence
  Description of Artificial Sequence: Synthetic peptide
REQLTQLVEFAKKN

SEQ ID NO: 6659 - protein, 14 aa, Artificial Sequence
  Description of Artificial Sequence: Synthetic peptide
LSTAQKIIKEARDA

SEQ ID NO: 6660 - protein, 14 aa, Artificial Sequence
  Description of Artificial Sequence: Synthetic peptide
NEKTAELIKELKEK

SEQ ID NO: 6661 - protein, 14 aa, Artificial Sequence
  Description of Artificial Sequence: Synthetic peptide
KEVVKANIDKIKSL

SEQ ID NO: 6662 - protein, 14 aa, Artificial Sequence
  Description of Artificial Sequence: Synthetic peptide
DESRGKARAAGVES

SEQ ID NO: 6663 - protein, 14 aa, Artificial Sequence
  Description of Artificial Sequence: Synthetic peptide
AEVHSQFDALKARI

SEQ ID NO: 6664 - protein, 14 aa, Artificial Sequence
  Description of Artificial Sequence: Synthetic peptide
PGQREKLFSKLIDI

SEQ ID NO: 6665 - protein, 14 aa, Artificial Sequence
  Description of Artificial Sequence: Synthetic peptide
NKAAREMKERVGQT

SEQ ID NO: 6666 - protein, 14 aa, Artificial Sequence
  Description of Artificial Sequence: Synthetic peptide
PDQVKASIDHIFKE

SEQ ID NO: 6667 - protein, 14 aa, Artificial Sequence
  Description of Artificial Sequence: Synthetic peptide
EVITSAMAKKAHEL

SEQ ID NO: 6668 - protein, 14 aa, Artificial Sequence
  Description of Artificial Sequence: Synthetic peptide
KDKTKGDAIDLSNA

SEQ ID NO: 6669 - protein, 14 aa, Artificial Sequence
  Description of Artificial Sequence: Synthetic peptide
ADHLLKAHLQKLMS

SEQ ID NO: 6670 - protein, 14 aa, Artificial Sequence
  Description of Artificial Sequence: Synthetic peptide
SLQIMEKIIKKAGD

SEQ ID NO: 6671 - protein, 14 aa, Artificial Sequence
  Description of Artificial Sequence: Synthetic peptide
SKEILAEAKKLNDA

SEQ ID NO: 6672 - protein, 14 aa, Artificial Sequence
  Description of Artificial Sequence: Synthetic peptide
EKVESEIKKVENFL

SEQ ID NO: 6673 - protein, 14 aa, Artificial Sequence
  Description of Artificial Sequence: Synthetic peptide
ADRVLKEFKDLLNS

SEQ ID NO: 6674 - protein, 14 aa, Artificial Sequence
  Description of Artificial Sequence: Synthetic peptide
AEFLVKSKHRDLTA

SEQ ID NO: 6675 - protein, 14 aa, Artificial Sequence
  Description of Artificial Sequence: Synthetic peptide
KETSDLLRKIAADS

SEQ ID NO: 6676 - protein, 14 aa, Artificial Sequence
  Description of Artificial Sequence: Synthetic peptide
HRDDVAEVTKLLAT

SEQ ID NO: 6677 - protein, 14 aa, Artificial Sequence
  Description of Artificial Sequence: Synthetic peptide
PETGESAARHLERA

SEQ ID NO: 6678 - protein, 14 aa, Artificial Sequence
  Description of Artificial Sequence: Synthetic peptide
FDDALNIVRKIGEN

SEQ ID NO: 6679 - protein, 14 aa, Artificial Sequence
  Description of Artificial Sequence: Synthetic peptide
REKLEAAASRIASL

SEQ ID NO: 6680 - protein, 14 aa, Artificial Sequence
  Description of Artificial Sequence: Synthetic peptide
QEGLRKHFGKVAES

SEQ ID NO: 6681 - protein, 14 aa, Artificial Sequence
  Description of Artificial Sequence: Synthetic peptide
RKLIDDAVAWAKQQ

SEQ ID NO: 6682 - protein, 14 aa, Artificial Sequence
  Description of Artificial Sequence: Synthetic peptide
DADKENIIALSKAL

SEQ ID NO: 6683 - protein, 14 aa, Artificial Sequence
  Description of Artificial Sequence: Synthetic peptide
PRTLNAWVKLVEEK

SEQ ID NO: 6684 - protein, 14 aa, Artificial Sequence
  Description of Artificial Sequence: Synthetic peptide
IQRRIKKVTHDMDM

SEQ ID NO: 6685 - protein, 14 aa, Artificial Sequence
  Description of Artificial Sequence: Synthetic peptide
FDDALRLTQKLTEA

SEQ ID NO: 6686 - protein, 14 aa, Artificial Sequence
  Description of Artificial Sequence: Synthetic peptide
KDRGMTLAVSKAVE

SEQ ID NO: 6687 - protein, 14 aa, Artificial Sequence
  Description of Artificial Sequence: Synthetic peptide
LSDYIKLTKENMRK

SEQ ID NO: 6688 - protein, 14 aa, Artificial Sequence
  Description of Artificial Sequence: Synthetic peptide
DRLTRAAKVLEQLS

SEQ ID NO: 6689 - protein, 14 aa, Artificial Sequence
  Description of Artificial Sequence: Synthetic peptide
VSEVKAIIKKQVDE

SEQ ID NO: 6690 - protein, 14 aa, Artificial Sequence
  Description of Artificial Sequence: Synthetic peptide
MSAVVKKVADRLTE

SEQ ID NO: 6691 - protein, 14 aa, Artificial Sequence
  Description of Artificial Sequence: Synthetic peptide
AVNHIKSVWKDLLE

SEQ ID NO: 6692 - protein, 14 aa, Artificial Sequence
  Description of Artificial Sequence: Synthetic peptide
HHELTRVASALRKL

SEQ ID NO: 6693 - protein, 14 aa, Artificial Sequence
  Description of Artificial Sequence: Synthetic peptide
RNDIVQSLEKAVDM

SEQ ID NO: 6694 - protein, 14 aa, Artificial Sequence
  Description of Artificial Sequence: Synthetic peptide
AQADLLNLKRKVDA

SEQ ID NO: 6695 - protein, 14 aa, Artificial Sequence
  Description of Artificial Sequence: Synthetic peptide
LDRFQEAISAIREV

SEQ ID NO: 6696 - protein, 14 aa, Artificial Sequence
  Description of Artificial Sequence: Synthetic peptide
VNEIDKIVERTREL

SEQ ID NO: 6697 - protein, 14 aa, Artificial Sequence
  Description of Artificial Sequence: Synthetic peptide
RGFLKQLRELDKQL

SEQ ID NO: 6698 - protein, 14 aa, Artificial Sequence
  Description of Artificial Sequence: Synthetic peptide
RLERARQMGASLEA

SEQ ID NO: 6699 - protein, 14 aa, Artificial Sequence
  Description of Artificial Sequence: Synthetic peptide
LDLARKELKKMQDQ

SEQ ID NO: 6700 - protein, 14 aa, Artificial Sequence
  Description of Artificial Sequence: Synthetic peptide
LNQLKRIVDKASEL

SEQ ID NO: 6701 - protein, 14 aa, Artificial Sequence
  Description of Artificial Sequence: Synthetic peptide
EKIIKEFITKTLTD

SEQ ID NO: 6702 - protein, 14 aa, Artificial Sequence
  Description of Artificial Sequence: Synthetic peptide
LEVSRAAERVFKKQ

SEQ ID NO: 6703 - protein, 14 aa, Artificial Sequence
  Description of Artificial Sequence: Synthetic peptide
RTTEKKIMDKLVQE

SEQ ID NO: 6704 - protein, 14 aa, Artificial Sequence
  Description of Artificial Sequence: Synthetic peptide
DRAEMVETQKTFTL

SEQ ID NO: 6705 - protein, 14 aa, Artificial Sequence
  Description of Artificial Sequence: Synthetic peptide
EDLKQKVLDNWTKM

SEQ ID NO: 6706 - protein, 14 aa, Artificial Sequence
  Description of Artificial Sequence: Synthetic peptide
RHMVHELVSNLRKE

SEQ ID NO: 6707 - protein, 14 aa, Artificial Sequence
  Description of Artificial Sequence: Synthetic peptide
LATLERYVETQAKE

SEQ ID NO: 6708 - protein, 14 aa, Artificial Sequence
  Description of Artificial Sequence: Synthetic peptide
EDLIWKLLSKAQEK

SEQ ID NO: 6709 - protein, 14 aa, Artificial Sequence
  Description of Artificial Sequence: Synthetic peptide
QDYVKELHQQITRL

SEQ ID NO: 6710 - protein, 14 aa, Artificial Sequence
  Description of Artificial Sequence: Synthetic peptide
RDHETSHSLAREVY

SEQ ID NO: 6711 - protein, 14 aa, Artificial Sequence
  Description of Artificial Sequence: Synthetic peptide
KAEVLKDENSRLNA

SEQ ID NO: 6712 - protein, 14 aa, Artificial Sequence
  Description of Artificial Sequence: Synthetic peptide
EALIRKASEISIKA

SEQ ID NO: 6713 - protein, 14 aa, Artificial Sequence
  Description of Artificial Sequence: Synthetic peptide
ESLVDQRIKEALSR

SEQ ID NO: 6714 - protein, 14 aa, Artificial Sequence
  Description of Artificial Sequence: Synthetic peptide
PKLLHRVVEQLQKV

SEQ ID NO: 6715 - protein, 14 aa, Artificial Sequence
  Description of Artificial Sequence: Synthetic peptide
SENQVIAVDTQREK

SEQ ID NO: 6716 - protein, 14 aa, Artificial Sequence
  Description of Artificial Sequence: Synthetic peptide
RELARQIMDVVTEM

SEQ ID NO: 6717 - protein, 14 aa, Artificial Sequence
  Description of Artificial Sequence: Synthetic peptide
HAQAVDYIKKLMTK

SEQ ID NO: 6718 - protein, 14 aa, Artificial Sequence
  Description of Artificial Sequence: Synthetic peptide
STDKDTLAVFVDRV

SEQ ID NO: 6719 - protein, 14 aa, Artificial Sequence
  Description of Artificial Sequence: Synthetic peptide
ADESIDIVKAVKTR

SEQ ID NO: 6720 - protein, 14 aa, Artificial Sequence
  Description of Artificial Sequence: Synthetic peptide
DKSHDQAVRTYQEH

SEQ ID NO: 6721 - protein, 14 aa, Artificial Sequence
  Description of Artificial Sequence: Synthetic peptide
WVDKVKDLTKSEMN

SEQ ID NO: 6722 - protein, 14 aa, Artificial Sequence
  Description of Artificial Sequence: Synthetic peptide
KDEMKKILEDFLNT

SEQ ID NO: 6723 - protein, 14 aa, Artificial Sequence
  Description of Artificial Sequence: Synthetic peptide
TDTLERVTEIFKAL

SEQ ID NO: 6724 - protein, 14 aa, Artificial Sequence
  Description of Artificial Sequence: Synthetic peptide
VRDVRDESNKLIAK

SEQ ID NO: 6725 - protein, 14 aa, Artificial Sequence
  Description of Artificial Sequence: Synthetic peptide
REALRAEWQATAKE

SEQ ID NO: 6726 - protein, 14 aa, Artificial Sequence
  Description of Artificial Sequence: Synthetic peptide
IVEKILQYRELTKL

SEQ ID NO: 6727 - protein, 14 aa, Artificial Sequence
  Description of Artificial Sequence: Synthetic peptide
PREIKNAIEKSVTD

SEQ ID NO: 6728 - protein, 14 aa, Artificial Sequence
  Description of Artificial Sequence: Synthetic peptide
TNRVELLAKKITDL

SEQ ID NO: 6729 - protein, 14 aa, Artificial Sequence
  Description of Artificial Sequence: Synthetic peptide
PHELSRVAATLRKL

SEQ ID NO: 6730 - protein, 14 aa, Artificial Sequence
  Description of Artificial Sequence: Synthetic peptide
KGYKLIAEVITKTD

SEQ ID NO: 6731 - protein, 14 aa, Artificial Sequence
  Description of Artificial Sequence: Synthetic peptide
RETLEISYRNAIAR

SEQ ID NO: 6732 - protein, 14 aa, Artificial Sequence
  Description of Artificial Sequence: Synthetic peptide
EETRNAVWAAIKEL

SEQ ID NO: 6733 - protein, 14 aa, Artificial Sequence
  Description of Artificial Sequence: Synthetic peptide
DNGLKVEVRSILEK

SEQ ID NO: 6734 - protein, 14 aa, Artificial Sequence
  Description of Artificial Sequence: Synthetic peptide
FQLATKIMDKLIRD

SEQ ID NO: 6735 - protein, 14 aa, Artificial Sequence
  Description of Artificial Sequence: Synthetic peptide
LREGVLVSEVLKEN

SEQ ID NO: 6736 - protein, 14 aa, Artificial Sequence
  Description of Artificial Sequence: Synthetic peptide
MYNGDRARKQVLVD

SEQ ID NO: 6737 - protein, 14 aa, Artificial Sequence
  Description of Artificial Sequence: Synthetic peptide
LDQAESIYKAAAER

SEQ ID NO: 6738 - protein, 14 aa, Artificial Sequence
  Description of Artificial Sequence: Synthetic peptide
REEWKGQAETNKIL

SEQ ID NO: 6739 - protein, 14 aa, Artificial Sequence
  Description of Artificial Sequence: Synthetic peptide
LKSLQVRLELAREL

SEQ ID NO: 6740 - protein, 14 aa, Artificial Sequence
  Description of Artificial Sequence: Synthetic peptide
SEQVVHQLERLIAR

SEQ ID NO: 6741 - protein, 14 aa, Artificial Sequence
  Description of Artificial Sequence: Synthetic peptide
EAMWRETIARVRTE

SEQ ID NO: 6742 - protein, 14 aa, Artificial Sequence
  Description of Artificial Sequence: Synthetic peptide
KSTLAVELEHQLVR

SEQ ID NO: 6743 - protein, 14 aa, Artificial Sequence
  Description of Artificial Sequence: Synthetic peptide
NEPHQRLESLVKSK

SEQ ID NO: 6744 - protein, 14 aa, Artificial Sequence
  Description of Artificial Sequence: Synthetic peptide
AFTKSVDELREMAG

SEQ ID NO: 6745 - protein, 14 aa, Artificial Sequence
  Description of Artificial Sequence: Synthetic peptide
AERIRQLETEAGER

SEQ ID NO: 6746 - protein, 14 aa, Artificial Sequence
  Description of Artificial Sequence: Synthetic peptide
EDDAIASIHRIFKN

SEQ ID NO: 6747 - protein, 14 aa, Artificial Sequence
  Description of Artificial Sequence: Synthetic peptide
QLDTAVVRALRERF

SEQ ID NO: 6748 - protein, 14 aa, Artificial Sequence
  Description of Artificial Sequence: Synthetic peptide
KEAETRVRALLKET

SEQ ID NO: 6749 - protein, 14 aa, Artificial Sequence
  Description of Artificial Sequence: Synthetic peptide
RELASQIHRELIKI

SEQ ID NO: 6750 - protein, 14 aa, Artificial Sequence
  Description of Artificial Sequence: Synthetic peptide
GPEASAFKKKMVEN

SEQ ID NO: 6751 - protein, 14 aa, Artificial Sequence
  Description of Artificial Sequence: Synthetic peptide
REGLEKHFQAIIDS

SEQ ID NO: 6752 - protein, 14 aa, Artificial Sequence
  Description of Artificial Sequence: Synthetic peptide
NVRELKNLIERAVI

SEQ ID NO: 6753 - protein, 14 aa, Artificial Sequence
  Description of Artificial Sequence: Synthetic peptide
IEKVGKILTTAHWD

SEQ ID NO: 6754 - protein, 14 aa, Artificial Sequence
  Description of Artificial Sequence: Synthetic peptide
EKDVVQILKAVSEF

SEQ ID NO: 6755 - protein, 14 aa, Artificial Sequence
  Description of Artificial Sequence: Synthetic peptide
ADSVEPMFRHLKNT

SEQ ID NO: 6756 - protein, 14 aa, Artificial Sequence
  Description of Artificial Sequence: Synthetic peptide
KKTLNEGLGLLERV

SEQ ID NO: 6757 - protein, 14 aa, Artificial Sequence
  Description of Artificial Sequence: Synthetic peptide
EKTIQYVKEAMKKH

SEQ ID NO: 6758 - protein, 14 aa, Artificial Sequence
  Description of Artificial Sequence: Synthetic peptide
KGERQDLVAYLKSA

SEQ ID NO: 6759 - protein, 14 aa, Artificial Sequence
  Description of Artificial Sequence: Synthetic peptide
PQDVVRLANWAHEH

SEQ ID NO: 6760 - protein, 14 aa, Artificial Sequence
  Description of Artificial Sequence: Synthetic peptide
VSDLKKYIAELEVQ

SEQ ID NO: 6761 - protein, 14 aa, Artificial Sequence
  Description of Artificial Sequence: Synthetic peptide
QEVAKELAENARKI

SEQ ID NO: 6762 - protein, 14 aa, Artificial Sequence
  Description of Artificial Sequence: Synthetic peptide
EKNVAKIFKTAREL

SEQ ID NO: 6763 - protein, 14 aa, Artificial Sequence
  Description of Artificial Sequence: Synthetic peptide
TENEKFLGKLVRDK

SEQ ID NO: 6764 - protein, 14 aa, Artificial Sequence
  Description of Artificial Sequence: Synthetic peptide
VIGNETKKQYEALE

SEQ ID NO: 6765 - protein, 14 aa, Artificial Sequence
  Description of Artificial Sequence: Synthetic peptide
TLKALQELIADVRD

SEQ ID NO: 6766 - protein, 14 aa, Artificial Sequence
  Description of Artificial Sequence: Synthetic peptide
SKEVLVHVKNLEKN

SEQ ID NO: 6767 - protein, 14 aa, Artificial Sequence
  Description of Artificial Sequence: Synthetic peptide
DIFNKNMRAHALEK

SEQ ID NO: 6768 - protein, 14 aa, Artificial Sequence
  Description of Artificial Sequence: Synthetic peptide
PNMNAERLQRTADR

SEQ ID NO: 6769 - protein, 14 aa, Artificial Sequence
  Description of Artificial Sequence: Synthetic peptide
TDKFIDAAKQVVRA

SEQ ID NO: 6770 - protein, 14 aa, Artificial Sequence
  Description of Artificial Sequence: Synthetic peptide
TPQVFKEIDRLREN

SEQ ID NO: 6771 - protein, 14 aa, Artificial Sequence
  Description of Artificial Sequence: Synthetic peptide
TEKVVFEQTKVIAD

SEQ ID NO: 6772 - protein, 14 aa, Artificial Sequence
  Description of Artificial Sequence: Synthetic peptide
DAHRQNLVNWVDKV

SEQ ID NO: 6773 - protein, 14 aa, Artificial Sequence
  Description of Artificial Sequence: Synthetic peptide
DANFERVRMLADQL

SEQ ID NO: 6774 - protein, 14 aa, Artificial Sequence
  Description of Artificial Sequence: Synthetic peptide
GRDLTDYLMKILTE

SEQ ID NO: 6775 - protein, 14 aa, Artificial Sequence
  Description of Artificial Sequence: Synthetic peptide
KSTNRDYLAERLRE

SEQ ID NO: 6776 - protein, 14 aa, Artificial Sequence
  Description of Artificial Sequence: Synthetic peptide
PEVAKQWERLVRAT

SEQ ID NO: 6777 - protein, 14 aa, Artificial Sequence
  Description of Artificial Sequence: Synthetic peptide
KNAREDFLDNAASL

SEQ ID NO: 6778 - protein, 14 aa, Artificial Sequence
  Description of Artificial Sequence: Synthetic peptide
PTRDALESLLAKLD

SEQ ID NO: 6779 - protein, 14 aa, Artificial Sequence
  Description of Artificial Sequence: Synthetic peptide
VGDLIKAYDNQKKL

SEQ ID NO: 6780 - protein, 14 aa, Artificial Sequence
  Description of Artificial Sequence: Synthetic peptide
QEHRDLAREAARKS

SEQ ID NO: 6781 - protein, 14 aa, Artificial Sequence
  Description of Artificial Sequence: Synthetic peptide
NYRTITKAIIRHVE

SEQ ID NO: 6782 - protein, 14 aa, Artificial Sequence
  Description of Artificial Sequence: Synthetic peptide
TEQKKQVFKVAKEA

SEQ ID NO: 6783 - protein, 14 aa, Artificial Sequence
  Description of Artificial Sequence: Synthetic peptide
KTEVKEMLNLAAKH

SEQ ID NO: 6784 - protein, 14 aa, Artificial Sequence
  Description of Artificial Sequence: Synthetic peptide
EEVKKNVLTQLNRV

SEQ ID NO: 6785 - protein, 14 aa, Artificial Sequence
  Description of Artificial Sequence: Synthetic peptide
VEEFKSIIVDIQRS

SEQ ID NO: 6786 - protein, 14 aa, Artificial Sequence
  Description of Artificial Sequence: Synthetic peptide
AATLEEKLNKIFEK

SEQ ID NO: 6787 - protein, 14 aa, Artificial Sequence
  Description of Artificial Sequence: Synthetic peptide
ATQVLAEVEEAKKA

SEQ ID NO: 6788 - protein, 14 aa, Artificial Sequence
  Description of Artificial Sequence: Synthetic peptide
ENRLRETRLNLSRL

SEQ ID NO: 6789 - protein, 14 aa, Artificial Sequence
  Description of Artificial Sequence: Synthetic peptide
ENLGARVKELYLQK

SEQ ID NO: 6790 - protein, 14 aa, Artificial Sequence
  Description of Artificial Sequence: Synthetic peptide
KAKAHTITVEAHST

SEQ ID NO: 6791 - protein, 14 aa, Artificial Sequence
  Description of Artificial Sequence: Synthetic peptide
ESAYLDNLKKELAN

SEQ ID NO: 6792 - protein, 14 aa, Artificial Sequence
  Description of Artificial Sequence: Synthetic peptide
TEMAKKITKLVKDS

SEQ ID NO: 6793 - protein, 14 aa, Artificial Sequence
  Description of Artificial Sequence: Synthetic peptide
RSDLHATLVDAARA

SEQ ID NO: 6794 - protein, 14 aa, Artificial Sequence
  Description of Artificial Sequence: Synthetic peptide
DEIVSAQKPFVAKH

SEQ ID NO: 6795 - protein, 14 aa, Artificial Sequence
  Description of Artificial Sequence: Synthetic peptide
DDIVEQQKPIAIKH

SEQ ID NO: 6796 - protein, 14 aa, Artificial Sequence
  Description of Artificial Sequence: Synthetic peptide
TEEMRDLVQRETGK

SEQ ID NO: 6797 - protein, 14 aa, Artificial Sequence
  Description of Artificial Sequence: Synthetic peptide
AAAEKQRLASLLKD

SEQ ID NO: 6798 - protein, 14 aa, Artificial Sequence
  Description of Artificial Sequence: Synthetic peptide
KKQLEDVFVLLNEN

SEQ ID NO: 6799 - protein, 14 aa, Artificial Sequence
  Description of Artificial Sequence: Synthetic peptide
TEYVDALKKLQMLH

SEQ ID NO: 6800 - protein, 14 aa, Artificial Sequence
  Description of Artificial Sequence: Synthetic peptide
KSSVAMLVERKLLE

SEQ ID NO: 6801 - protein, 14 aa, Artificial Sequence
  Description of Artificial Sequence: Synthetic peptide
AKVSEALEKRYSMT

SEQ ID NO: 6802 - protein, 14 aa, Artificial Sequence
  Description of Artificial Sequence: Synthetic peptide
GEKLYTGLREVVTE

SEQ ID NO: 6803 - protein, 14 aa, Artificial Sequence
  Description of Artificial Sequence: Synthetic peptide
GESLKNLIDFHINH

SEQ ID NO: 6804 - protein, 14 aa, Artificial Sequence
  Description of Artificial Sequence: Synthetic peptide
QLELRDAVEHARTT

SEQ ID NO: 6805 - protein, 14 aa, Artificial Sequence
  Description of Artificial Sequence: Synthetic peptide
AAITHTARMADKLR

SEQ ID NO: 6806 - protein, 14 aa, Artificial Sequence
  Description of Artificial Sequence: Synthetic peptide
ENARKYVERVSELT

SEQ ID NO: 6807 - protein, 14 aa, Artificial Sequence
  Description of Artificial Sequence: Synthetic peptide
LTEVQTIVEQVKEK

SEQ ID NO: 6808 - protein, 14 aa, Artificial Sequence
  Description of Artificial Sequence: Synthetic peptide
EMRKGIDLATTLER

SEQ ID NO: 6809 - protein, 14 aa, Artificial Sequence
  Description of Artificial Sequence: Synthetic peptide
LTRAAVELAKEWRT

SEQ ID NO: 6810 - protein, 14 aa, Artificial Sequence
  Description of Artificial Sequence: Synthetic peptide
RQTEDQLKKLKGYT

SEQ ID NO: 6811 - protein, 14 aa, Artificial Sequence
  Description of Artificial Sequence: Synthetic peptide
DQQRDFQREIQILK

SEQ ID NO: 6812 - protein, 14 aa, Artificial Sequence
  Description of Artificial Sequence: Synthetic peptide
ADKLLTLEVKSLDT

SEQ ID NO: 6813 - protein, 14 aa, Artificial Sequence
  Description of Artificial Sequence: Synthetic peptide
LEAARQFSEAVKAE

SEQ ID NO: 6814 - protein, 14 aa, Artificial Sequence
  Description of Artificial Sequence: Synthetic peptide
SRVADYRDNMAKQT

SEQ ID NO: 6815 - protein, 14 aa, Artificial Sequence
  Description of Artificial Sequence: Synthetic peptide
DHTKKAVLEAKEKT

SEQ ID NO: 6816 - protein, 14 aa, Artificial Sequence
  Description of Artificial Sequence: Synthetic peptide
ERGKKQAKLLAQEL

SEQ ID NO: 6817 - protein, 14 aa, Artificial Sequence
  Description of Artificial Sequence: Synthetic peptide
TEELVQKIKAIKEV

SEQ ID NO: 6818 - protein, 14 aa, Artificial Sequence
  Description of Artificial Sequence: Synthetic peptide
LLKSAVELAKDWRT

SEQ ID NO: 6819 - protein, 14 aa, Artificial Sequence
  Description of Artificial Sequence: Synthetic peptide
PERTEVLGRAAEAT

SEQ ID NO: 6820 - protein, 14 aa, Artificial Sequence
  Description of Artificial Sequence: Synthetic peptide
LTNHQKFAKANVRE

SEQ ID NO: 6821 - protein, 14 aa, Artificial Sequence
  Description of Artificial Sequence: Synthetic peptide
QVRTEELLTGRALE

SEQ ID NO: 6822 - protein, 14 aa, Artificial Sequence
  Description of Artificial Sequence: Synthetic peptide
LENVLEAARHLHQT

SEQ ID NO: 6823 - protein, 14 aa, Artificial Sequence
  Description of Artificial Sequence: Synthetic peptide
PRDVAVSSFHHARL

SEQ ID NO: 6824 - protein, 14 aa, Artificial Sequence
  Description of Artificial Sequence: Synthetic peptide
DETLFKTLVKAKEL

SEQ ID NO: 6825 - protein, 14 aa, Artificial Sequence
  Description of Artificial Sequence: Synthetic peptide
PKVIHQALEDKIAQ

SEQ ID NO: 6826 - protein, 14 aa, Artificial Sequence
  Description of Artificial Sequence: Synthetic peptide
REQAEQVLRVALKH

SEQ ID NO: 6827 - protein, 14 aa, Artificial Sequence
  Description of Artificial Sequence: Synthetic peptide
DGEMYQTLRLAKEL

SEQ ID NO: 6828 - protein, 14 aa, Artificial Sequence
  Description of Artificial Sequence: Synthetic peptide
DHGKTTLSKVLTEI

SEQ ID NO: 6829 - protein, 14 aa, Artificial Sequence
  Description of Artificial Sequence: Synthetic peptide
RAEVAMMLNDRNRE

SEQ ID NO: 6830 - protein, 14 aa, Artificial Sequence
  Description of Artificial Sequence: Synthetic peptide
PDEAARQALEKQRE

SEQ ID NO: 6831 - protein, 14 aa, Artificial Sequence
  Description of Artificial Sequence: Synthetic peptide
DTLQARAMLDIVKR

SEQ ID NO: 6832 - protein, 14 aa, Artificial Sequence
  Description of Artificial Sequence: Synthetic peptide
QVRLERILDEISKE

SEQ ID NO: 6833 - protein, 14 aa, Artificial Sequence
  Description of Artificial Sequence: Synthetic peptide
LATKLFDNLERVKE

SEQ ID NO: 6834 - protein, 14 aa, Artificial Sequence
  Description of Artificial Sequence: Synthetic peptide
PRTLNAWVKVVEEK

SEQ ID NO: 6835 - protein, 14 aa, Artificial Sequence
  Description of Artificial Sequence: Synthetic peptide
SAAERELIGRFQDR

SEQ ID NO: 6836 - protein, 14 aa, Artificial Sequence
  Description of Artificial Sequence: Synthetic peptide
KALDKVEKVLVSAQ

SEQ ID NO: 6837 - protein, 14 aa, Artificial Sequence
  Description of Artificial Sequence: Synthetic peptide
RKQLHQLVDFAKTN

SEQ ID NO: 6838 - protein, 14 aa, Artificial Sequence
  Description of Artificial Sequence: Synthetic peptide
LEEAVNAEARKIAN

SEQ ID NO: 6839 - protein, 14 aa, Artificial Sequence
  Description of Artificial Sequence: Synthetic peptide
AESVEQAIAAREHR

SEQ ID NO: 6840 - protein, 14 aa, Artificial Sequence
  Description of Artificial Sequence: Synthetic peptide
DEQRKLLKEAQAEH

SEQ ID NO: 6841 - protein, 14 aa, Artificial Sequence
  Description of Artificial Sequence: Synthetic peptide
FKEISDDVKEKNKN

SEQ ID NO: 6842 - protein, 14 aa, Artificial Sequence
  Description of Artificial Sequence: Synthetic peptide
VEKVLKTRYHDATS

SEQ ID NO: 6843 - protein, 14 aa, Artificial Sequence
  Description of Artificial Sequence: Synthetic peptide
RETLLTMAERARAA

SEQ ID NO: 6844 - protein, 14 aa, Artificial Sequence
  Description of Artificial Sequence: Synthetic peptide
ADKVYKTLQRLRDL

SEQ ID NO: 6845 - protein, 14 aa, Artificial Sequence
  Description of Artificial Sequence: Synthetic peptide
PDDQQKEVVNMAQK

SEQ ID NO: 6846 - protein, 14 aa, Artificial Sequence
  Description of Artificial Sequence: Synthetic peptide
VERIFSIVEQRLEA

SEQ ID NO: 6847 - protein, 14 aa, Artificial Sequence
  Description of Artificial Sequence: Synthetic peptide
FDDVTDLLRKTLVS

SEQ ID NO: 6848 - protein, 14 aa, Artificial Sequence
  Description of Artificial Sequence: Synthetic peptide
EREASDIINNLRNF

SEQ ID NO: 6849 - protein, 14 aa, Artificial Sequence
  Description of Artificial Sequence: Synthetic peptide
WDTLEAVVKEKLAS

SEQ ID NO: 6850 - protein, 14 aa, Artificial Sequence
  Description of Artificial Sequence: Synthetic peptide
ADAHSNLASIHKDS

SEQ ID NO: 6851 - protein, 14 aa, Artificial Sequence
  Description of Artificial Sequence: Synthetic peptide
EASVRLAERLAKQA

SEQ ID NO: 6852 - protein, 14 aa, Artificial Sequence
  Description of Artificial Sequence: Synthetic peptide
AAIKAKDDFQMEIT

SEQ ID NO: 6853 - protein, 14 aa, Artificial Sequence
  Description of Artificial Sequence: Synthetic peptide
KEAATAVAKAFEQE

SEQ ID NO: 6854 - protein, 14 aa, Artificial Sequence
  Description of Artificial Sequence: Synthetic peptide
YKKRLNELITDALI

SEQ ID NO: 6855 - protein, 14 aa, Artificial Sequence
  Description of Artificial Sequence: Synthetic peptide
GEVAQIIRKVGTRE

SEQ ID NO: 6856 - protein, 14 aa, Artificial Sequence
  Description of Artificial Sequence: Synthetic peptide
EVEKNLVREAVKKS

SEQ ID NO: 6857 - protein, 14 aa, Artificial Sequence
  Description of Artificial Sequence: Synthetic peptide
KLERERMQNEYAKS

SEQ ID NO: 6858 - protein, 14 aa, Artificial Sequence
  Description of Artificial Sequence: Synthetic peptide
ESDLKRIGAIHFKT

SEQ ID NO: 6859 - protein, 14 aa, Artificial Sequence
  Description of Artificial Sequence: Synthetic peptide
DNQIGEVVKGFEKK

SEQ ID NO: 6860 - protein, 14 aa, Artificial Sequence
  Description of Artificial Sequence: Synthetic peptide
YNDEKKLASNEIAN

SEQ ID NO: 6861 - protein, 14 aa, Artificial Sequence
  Description of Artificial Sequence: Synthetic peptide
ITKHMERYLDILNS

SEQ ID NO: 6862 - protein, 14 aa, Artificial Sequence
  Description of Artificial Sequence: Synthetic peptide
FNRDIQLLKALDNE

SEQ ID NO: 6863 - protein, 14 aa, Artificial Sequence
  Description of Artificial Sequence: Synthetic peptide
ILEAQKIKKLADSA

SEQ ID NO: 6864 - protein, 14 aa, Artificial Sequence
  Description of Artificial Sequence: Synthetic peptide
KETQQRQIDLFTKV

SEQ ID NO: 6865 - protein, 14 aa, Artificial Sequence
  Description of Artificial Sequence: Synthetic peptide
DASEVTIRKAIARF

SEQ ID NO: 6866 - protein, 14 aa, Artificial Sequence
  Description of Artificial Sequence: Synthetic peptide
VQEAQGKWPALKEK

SEQ ID NO: 6867 - protein, 14 aa, Artificial Sequence
  Description of Artificial Sequence: Synthetic peptide
LGKTLDDQERKIAN

SEQ ID NO: 6868 - protein, 14 aa, Artificial Sequence
  Description of Artificial Sequence: Synthetic peptide
LTKAAVELAKDWRT

SEQ ID NO: 6869 - protein, 14 aa, Artificial Sequence
  Description of Artificial Sequence: Synthetic peptide
DYRGGQLAAKHLQE

SEQ ID NO: 6870 - protein, 14 aa, Artificial Sequence
  Description of Artificial Sequence: Synthetic peptide
VEGIFNDVVENVKR

SEQ ID NO: 6871 - protein, 14 aa, Artificial Sequence
  Description of Artificial Sequence: Synthetic peptide
PEDKSRIVSELKDK

SEQ ID NO: 6872 - protein, 14 aa, Artificial Sequence
  Description of Artificial Sequence: Synthetic peptide
EVTVRNRYKELVEK

SEQ ID NO: 6873 - protein, 14 aa, Artificial Sequence
  Description of Artificial Sequence: Synthetic peptide
KIVQERLEKVIASA

SEQ ID NO: 6874 - protein, 14 aa, Artificial Sequence
  Description of Artificial Sequence: Synthetic peptide
HEAFQNRVNELAAK

SEQ ID NO: 6875 - protein, 14 aa, Artificial Sequence
  Description of Artificial Sequence: Synthetic peptide
AEHRTLAREAVRKS

SEQ ID NO: 6876 - protein, 14 aa, Artificial Sequence
  Description of Artificial Sequence: Synthetic peptide
PPDHTRLRGLVSKA

SEQ ID NO: 6877 - protein, 14 aa, Artificial Sequence
  Description of Artificial Sequence: Synthetic peptide
TRELFEGAVRQIRL

SEQ ID NO: 6878 - protein, 14 aa, Artificial Sequence
  Description of Artificial Sequence: Synthetic peptide
EKTVEAFAEAVKTV

SEQ ID NO: 6879 - protein, 14 aa, Artificial Sequence
  Description of Artificial Sequence: Synthetic peptide
SDLVDQGKERLNRL

SEQ ID NO: 6880 - protein, 14 aa, Artificial Sequence
  Description of Artificial Sequence: Synthetic peptide
TDVDAANLRETFRN

SEQ ID NO: 6881 - protein, 14 aa, Artificial Sequence
  Description of Artificial Sequence: Synthetic peptide
MRERIEFLNEASVM

SEQ ID NO: 6882 - protein, 14 aa, Artificial Sequence
  Description of Artificial Sequence: Synthetic peptide
EKDRNDLITYLKKA

SEQ ID NO: 6883 - protein, 14 aa, Artificial Sequence
  Description of Artificial Sequence: Synthetic peptide
KSTVLAKVKEILDN

SEQ ID NO: 6884 - protein, 14 aa, Artificial Sequence
  Description of Artificial Sequence: Synthetic peptide
LTPRKRLKESLDQI

SEQ ID NO: 6885 - protein, 14 aa, Artificial Sequence
  Description of Artificial Sequence: Synthetic peptide
EETTAKLIYSKVRT

SEQ ID NO: 6886 - protein, 14 aa, Artificial Sequence
  Description of Artificial Sequence: Synthetic peptide
DRVRESLFNIVTAR

SEQ ID NO: 6887 - protein, 14 aa, Artificial Sequence
  Description of Artificial Sequence: Synthetic peptide
DVTLLKTLDKAVKT

SEQ ID NO: 6888 - protein, 14 aa, Artificial Sequence
  Description of Artificial Sequence: Synthetic peptide
EKTVELLRNVLKES

SEQ ID NO: 6889 - protein, 14 aa, Artificial Sequence
  Description of Artificial Sequence: Synthetic peptide
GSKEIDTVIELKKH

SEQ ID NO: 6890 - protein, 14 aa, Artificial Sequence
  Description of Artificial Sequence: Synthetic peptide
RAVNNEYVKVMREK

SEQ ID NO: 6891 - protein, 14 aa, Artificial Sequence
  Description of Artificial Sequence: Synthetic peptide
EITSKKIARERIDA

SEQ ID NO: 6892 - protein, 14 aa, Artificial Sequence
  Description of Artificial Sequence: Synthetic peptide
EDISKKIAQERMDA

SEQ ID NO: 6893 - protein, 14 aa, Artificial Sequence
  Description of Artificial Sequence: Synthetic peptide
WGVTKAAEKQMKDK

SEQ ID NO: 6894 - protein, 14 aa, Artificial Sequence
  Description of Artificial Sequence: Synthetic peptide
SDLVYETINRVKRI

SEQ ID NO: 6895 - protein, 14 aa, Artificial Sequence
  Description of Artificial Sequence: Synthetic peptide
PKEIQIQIRKFVGE

SEQ ID NO: 6896 - protein, 14 aa, Artificial Sequence
  Description of Artificial Sequence: Synthetic peptide
EKDRNDSITYLKKA

SEQ ID NO: 6897 - protein, 14 aa, Artificial Sequence
  Description of Artificial Sequence: Synthetic peptide
TSVKVKEAVEAVRD

SEQ ID NO: 6898 - protein, 14 aa, Artificial Sequence
  Description of Artificial Sequence: Synthetic peptide
TSAVYNELDRLREV

SEQ ID NO: 6899 - protein, 14 aa, Artificial Sequence
  Description of Artificial Sequence: Synthetic peptide
DKVALNWLKGLKEN

SEQ ID NO: 6900 - protein, 14 aa, Artificial Sequence
  Description of Artificial Sequence: Synthetic peptide
NRMIDSVLESARDM

SEQ ID NO: 6901 - protein, 14 aa, Artificial Sequence
  Description of Artificial Sequence: Synthetic peptide
LSVMKETYETVMKK

SEQ ID NO: 6902 - protein, 14 aa, Artificial Sequence
  Description of Artificial Sequence: Synthetic peptide
LYQRIAKIVSIDDD

SEQ ID NO: 6903 - protein, 14 aa, Artificial Sequence
  Description of Artificial Sequence: Synthetic peptide
EETQRTFLKEVKVM

SEQ ID NO: 6904 - protein, 14 aa, Artificial Sequence
  Description of Artificial Sequence: Synthetic peptide
PETAETLYKEIRKV

SEQ ID NO: 6905 - protein, 14 aa, Artificial Sequence
  Description of Artificial Sequence: Synthetic peptide
LDAVRTLKTVIDEK

SEQ ID NO: 6906 - protein, 14 aa, Artificial Sequence
  Description of Artificial Sequence: Synthetic peptide
RTAVKKVIDQLKLE

SEQ ID NO: 6907 - protein, 14 aa, Artificial Sequence
  Description of Artificial Sequence: Synthetic peptide
PARVVQLFRDVEQK

SEQ ID NO: 6908 - protein, 14 aa, Artificial Sequence
  Description of Artificial Sequence: Synthetic peptide
HSETVAKHGAKLSA

SEQ ID NO: 6909 - protein, 14 aa, Artificial Sequence
  Description of Artificial Sequence: Synthetic peptide
SAHLDRLQKAADKI

SEQ ID NO: 6910 - protein, 14 aa, Artificial Sequence
  Description of Artificial Sequence: Synthetic peptide
GKTLDTAKAVADEL

SEQ ID NO: 6911 - protein, 14 aa, Artificial Sequence
  Description of Artificial Sequence: Synthetic peptide
ESMNKELKKIIGQV

SEQ ID NO: 6912 - protein, 14 aa, Artificial Sequence
  Description of Artificial Sequence: Synthetic peptide
HDKAIEAYEKTISI

SEQ ID NO: 6913 - protein, 14 aa, Artificial Sequence
  Description of Artificial Sequence: Synthetic peptide
LDTVREEVKTLKER

SEQ ID NO: 6914 - protein, 14 aa, Artificial Sequence
  Description of Artificial Sequence: Synthetic peptide
NNRMELKAAIEGLK

SEQ ID NO: 6915 - protein, 14 aa, Artificial Sequence
  Description of Artificial Sequence: Synthetic peptide
KNVAAAERQLRELE

SEQ ID NO: 6916 - protein, 14 aa, Artificial Sequence
  Description of Artificial Sequence: Synthetic peptide
LTETVGELVRVAER

SEQ ID NO: 6917 - protein, 14 aa, Artificial Sequence
  Description of Artificial Sequence: Synthetic peptide
DMWVTIDKRMAEIT

SEQ ID NO: 6918 - protein, 14 aa, Artificial Sequence
  Description of Artificial Sequence: Synthetic peptide
PLKTAHDVRVTFAR

SEQ ID NO: 6919 - protein, 14 aa, Artificial Sequence
  Description of Artificial Sequence: Synthetic peptide
PHDTLNRIKKYLLT

SEQ ID NO: 6920 - protein, 14 aa, Artificial Sequence
  Description of Artificial Sequence: Synthetic peptide
ENTAIHHYLEALKV

SEQ ID NO: 6921 - protein, 14 aa, Artificial Sequence
  Description of Artificial Sequence: Synthetic peptide
IGDTAKKLGEMWSE

SEQ ID NO: 6922 - protein, 14 aa, Artificial Sequence
  Description of Artificial Sequence: Synthetic peptide
SLDKAKALKEQLEK

SEQ ID NO: 6923 - protein, 14 aa, Artificial Sequence
  Description of Artificial Sequence: Synthetic peptide
ARQDFQREAELLTM

SEQ ID NO: 6924 - protein, 14 aa, Artificial Sequence
  Description of Artificial Sequence: Synthetic peptide
FRDLALRVDQIRDQ

SEQ ID NO: 6925 - protein, 14 aa, Artificial Sequence
  Description of Artificial Sequence: Synthetic peptide
HDIKEDFSNLIRTL

SEQ ID NO: 6926 - protein, 14 aa, Artificial Sequence
  Description of Artificial Sequence: Synthetic peptide
ERTRKTGEAFAAGL

SEQ ID NO: 6927 - protein, 14 aa, Artificial Sequence
  Description of Artificial Sequence: Synthetic peptide
PHQLRHSFATHMLE

SEQ ID NO: 6928 - protein, 14 aa, Artificial Sequence
  Description of Artificial Sequence: Synthetic peptide
KTLAGQLHSELKEF

SEQ ID NO: 6929 - protein, 14 aa, Artificial Sequence
  Description of Artificial Sequence: Synthetic peptide
LYDALEKARDLLNN

SEQ ID NO: 6930 - protein, 14 aa, Artificial Sequence
  Description of Artificial Sequence: Synthetic peptide
WRAAMRKADTALSE

SEQ ID NO: 6931 - protein, 14 aa, Artificial Sequence
  Description of Artificial Sequence: Synthetic peptide
DETLFKTLIRAKEL

SEQ ID NO: 6932 - protein, 14 aa, Artificial Sequence
  Description of Artificial Sequence: Synthetic peptide
VQEGVDKIRHFQEL

SEQ ID NO: 6933 - protein, 14 aa, Artificial Sequence
  Description of Artificial Sequence: Synthetic peptide
REAHETLAIAMNRL

SEQ ID NO: 6934 - protein, 14 aa, Artificial Sequence
  Description of Artificial Sequence: Synthetic peptide
TDQLVRFIDEAHRA

SEQ ID NO: 6935 - protein, 14 aa, Artificial Sequence
  Description of Artificial Sequence: Synthetic peptide
DQERQVFQKALGKL

SEQ ID NO: 6936 - protein, 14 aa, Artificial Sequence
  Description of Artificial Sequence: Synthetic peptide
KTHLLQAAGNEAKK

SEQ ID NO: 6937 - protein, 14 aa, Artificial Sequence
  Description of Artificial Sequence: Synthetic peptide
HEFLSKVSHRIVNE

SEQ ID NO: 6938 - protein, 14 aa, Artificial Sequence
  Description of Artificial Sequence: Synthetic peptide
DTMKQAFDRMTKLR

SEQ ID NO: 6939 - protein, 14 aa, Artificial Sequence
  Description of Artificial Sequence: Synthetic peptide
LEELFSKIKNTLKV

SEQ ID NO: 6940 - protein, 14 aa, Artificial Sequence
  Description of Artificial Sequence: Synthetic peptide
DIVRERAIKFLSTK

SEQ ID NO: 6941 - protein, 14 aa, Artificial Sequence
  Description of Artificial Sequence: Synthetic peptide
VTKIKEVQRIAVEE

SEQ ID NO: 6942 - protein, 14 aa, Artificial Sequence
  Description of Artificial Sequence: Synthetic peptide
RASLKKLIDYHVAS

SEQ ID NO: 6943 - protein, 14 aa, Artificial Sequence
  Description of Artificial Sequence: Synthetic peptide
PAEFVDIKHRLTQI

SEQ ID NO: 6944 - protein, 14 aa, Artificial Sequence
  Description of Artificial Sequence: Synthetic peptide
LRDIVRANERGIQA

SEQ ID NO: 6945 - protein, 14 aa, Artificial Sequence
  Description of Artificial Sequence: Synthetic peptide
LGPHEANLFDMRQK

SEQ ID NO: 6946 - protein, 14 aa, Artificial Sequence
  Description of Artificial Sequence: Synthetic peptide
PIKHVSLMDQRARQ

SEQ ID NO: 6947 - protein, 14 aa, Artificial Sequence
  Description of Artificial Sequence: Synthetic peptide
DLLKHTTNVVKAHT

SEQ ID NO: 6948 - protein, 14 aa, Artificial Sequence
  Description of Artificial Sequence: Synthetic peptide
NETREKLHQLEKSL

SEQ ID NO: 6949 - protein, 14 aa, Artificial Sequence
  Description of Artificial Sequence: Synthetic peptide
DKVREKITLVEEKT

SEQ ID NO: 6950 - protein, 14 aa, Artificial Sequence
  Description of Artificial Sequence: Synthetic peptide
SEVREQINAKVAEW

SEQ ID NO: 6951 - protein, 14 aa, Artificial Sequence
  Description of Artificial Sequence: Synthetic peptide
RKITDDLVKNVEKL

SEQ ID NO: 6952 - protein, 14 aa, Artificial Sequence
  Description of Artificial Sequence: Synthetic peptide
NQLDSQRLKERLYN

SEQ ID NO: 6953 - protein, 14 aa, Artificial Sequence
  Description of Artificial Sequence: Synthetic peptide
KKELEVLSQKLRAL

SEQ ID NO: 6954 - protein, 14 aa, Artificial Sequence
  Description of Artificial Sequence: Synthetic peptide
TALADTGAKLHDKY

SEQ ID NO: 6955 - protein, 14 aa, Artificial Sequence
  Description of Artificial Sequence: Synthetic peptide
EVIDKIQKKTREFL

SEQ ID NO: 6956 - protein, 14 aa, Artificial Sequence
  Description of Artificial Sequence: Synthetic peptide
PQEKDISSKLLKAL

SEQ ID NO: 6957 - protein, 14 aa, Artificial Sequence
  Description of Artificial Sequence: Synthetic peptide
PYSSRLKKIGELLD

SEQ ID NO: 6958 - protein, 14 aa, Artificial Sequence
  Description of Artificial Sequence: Synthetic peptide
PYSSRLKKVGELLD

SEQ ID NO: 6959 - protein, 14 aa, Artificial Sequence
  Description of Artificial Sequence: Synthetic peptide
RAKVLGARNLHELT

SEQ ID NO: 6960 - protein, 14 aa, Artificial Sequence
  Description of Artificial Sequence: Synthetic peptide
KELHTELEQAGRFV

SEQ ID NO: 6961 - protein, 14 aa, Artificial Sequence
  Description of Artificial Sequence: Synthetic peptide
ESVRDALVRAQDYI

SEQ ID NO: 6962 - protein, 14 aa, Artificial Sequence
  Description of Artificial Sequence: Synthetic peptide
DQLRAGYVARASER

SEQ ID NO: 6963 - protein, 14 aa, Artificial Sequence
  Description of Artificial Sequence: Synthetic peptide
SEGLKSVVDHIKAN

SEQ ID NO: 6964 - protein, 14 aa, Artificial Sequence
  Description of Artificial Sequence: Synthetic peptide
PREVIEAIKNLAKT

SEQ ID NO: 6965 - protein, 14 aa, Artificial Sequence
  Description of Artificial Sequence: Synthetic peptide
LKDAINEAMRDWVT

SEQ ID NO: 6966 - protein, 14 aa, Artificial Sequence
  Description of Artificial Sequence: Synthetic peptide
YALRKHLVELAKTN

SEQ ID NO: 6967 - protein, 14 aa, Artificial Sequence
  Description of Artificial Sequence: Synthetic peptide
WERLLEKRQIGADT

SEQ ID NO: 6968 - protein, 14 aa, Artificial Sequence
  Description of Artificial Sequence: Synthetic peptide
QNGLEQAKKFHEAV

SEQ ID NO: 6969 - protein, 14 aa, Artificial Sequence
  Description of Artificial Sequence: Synthetic peptide
LDESVGKIWQKLVD

SEQ ID NO: 6970 - protein, 14 aa, Artificial Sequence
  Description of Artificial Sequence: Synthetic peptide
LEKTHELKEVLNKV

SEQ ID NO: 6971 - protein, 14 aa, Artificial Sequence
  Description of Artificial Sequence: Synthetic peptide
NRGLEIAKIAEKVS

SEQ ID NO: 6972 - protein, 14 aa, Artificial Sequence
  Description of Artificial Sequence: Synthetic peptide
EQLENEIIKAGKAS

SEQ ID NO: 6973 - protein, 14 aa, Artificial Sequence
  Description of Artificial Sequence: Synthetic peptide
RESQLNDAIKILNE

SEQ ID NO: 6974 - protein, 14 aa, Artificial Sequence
  Description of Artificial Sequence: Synthetic peptide
SDQRDAIVKGLKAK

SEQ ID NO: 6975 - protein, 14 aa, Artificial Sequence
  Description of Artificial Sequence: Synthetic peptide
ATQVLKELEEAKKA

SEQ ID NO: 6976 - protein, 14 aa, Artificial Sequence
  Description of Artificial Sequence: Synthetic peptide
DSVTARLREVEHRA

SEQ ID NO: 6977 - protein, 14 aa, Artificial Sequence
  Description of Artificial Sequence: Synthetic peptide
PGERDALLANEATK

SEQ ID NO: 6978 - protein, 14 aa, Artificial Sequence
  Description of Artificial Sequence: Synthetic peptide
NSKAKENAETTLLR

SEQ ID NO: 6979 - protein, 14 aa, Artificial Sequence
  Description of Artificial Sequence: Synthetic peptide
ITETAKKWVPEMRE

SEQ ID NO: 6980 - protein, 14 aa, Artificial Sequence
  Description of Artificial Sequence: Synthetic peptide
FENLIPILKTVHEK

SEQ ID NO: 6981 - protein, 14 aa, Artificial Sequence
  Description of Artificial Sequence: Synthetic peptide
NKEAKAWAKGVLEN

SEQ ID NO: 6982 - protein, 14 aa, Artificial Sequence
  Description of Artificial Sequence: Synthetic peptide
DVSKTIKEAIETTI

SEQ ID NO: 6983 - protein, 14 aa, Artificial Sequence
  Description of Artificial Sequence: Synthetic peptide
SMELLKQAYDKVRE

SEQ ID NO: 6984 - protein, 14 aa, Artificial Sequence
  Description of Artificial Sequence: Synthetic peptide
KQEFDTHMANGKDT

SEQ ID NO: 6985 - protein, 14 aa, Artificial Sequence
  Description of Artificial Sequence: Synthetic peptide
RSKGKEVMESFIKA

SEQ ID NO: 6986 - protein, 14 aa, Artificial Sequence
  Description of Artificial Sequence: Synthetic peptide
QEKAKTLLDKALTQ

SEQ ID NO: 6987 - protein, 14 aa, Artificial Sequence
  Description of Artificial Sequence: Synthetic peptide
THLADVLVSKQFHE

SEQ ID NO: 6988 - protein, 14 aa, Artificial Sequence
  Description of Artificial Sequence: Synthetic peptide
VDKIREFLQKISKE

SEQ ID NO: 6989 - protein, 14 aa, Artificial Sequence
  Description of Artificial Sequence: Synthetic peptide
RARIHALLDQVAES

SEQ ID NO: 6990 - protein, 14 aa, Artificial Sequence
  Description of Artificial Sequence: Synthetic peptide
PDVTRDILVNLDKV

SEQ ID NO: 6991 - protein, 14 aa, Artificial Sequence
  Description of Artificial Sequence: Synthetic peptide
IDTVLYMKEKATKA

SEQ ID NO: 6992 - protein, 14 aa, Artificial Sequence
  Description of Artificial Sequence: Synthetic peptide
ELFRKEATKLIGQI

SEQ ID NO: 6993 - protein, 14 aa, Artificial Sequence
  Description of Artificial Sequence: Synthetic peptide
FIKINDLAEQIEKI

SEQ ID NO: 6994 - protein, 14 aa, Artificial Sequence
  Description of Artificial Sequence: Synthetic peptide
KDRIGFSMISDAEK

SEQ ID NO: 6995 - protein, 14 aa, Artificial Sequence
  Description of Artificial Sequence: Synthetic peptide
LEKAKETILSILKK

SEQ ID NO: 6996 - protein, 14 aa, Artificial Sequence
  Description of Artificial Sequence: Synthetic peptide
EKVRESLRLTFHDA

SEQ ID NO: 6997 - protein, 14 aa, Artificial Sequence
  Description of Artificial Sequence: Synthetic peptide
QQRDFQREIQILKA

SEQ ID NO: 6998 - protein, 14 aa, Artificial Sequence
  Description of Artificial Sequence: Synthetic peptide
PHELTRVASALRKL

SEQ ID NO: 6999 - protein, 14 aa, Artificial Sequence
  Description of Artificial Sequence: Synthetic peptide
TEHLDAVFQRMKTE

SEQ ID NO: 7000 - protein, 14 aa, Artificial Sequence
  Description of Artificial Sequence: Synthetic peptide
EKIQKEAQEALEKL

SEQ ID NO: 7001 - protein, 14 aa, Artificial Sequence
  Description of Artificial Sequence: Synthetic peptide
PENTRLFEMVKRKE

SEQ ID NO: 7002 - protein, 14 aa, Artificial Sequence
  Description of Artificial Sequence: Synthetic peptide
QTHAKRAYRELVLM

SEQ ID NO: 7003 - protein, 14 aa, Artificial Sequence
  Description of Artificial Sequence: Synthetic peptide
MANMRAVRELTEAH

SEQ ID NO: 7004 - protein, 14 aa, Artificial Sequence
  Description of Artificial Sequence: Synthetic peptide
DTKLAEYTDLMLKL

SEQ ID NO: 7005 - protein, 14 aa, Artificial Sequence
  Description of Artificial Sequence: Synthetic peptide
QHERYVEQLKQALK

SEQ ID NO: 7006 - protein, 14 aa, Artificial Sequence
  Description of Artificial Sequence: Synthetic peptide
SEKGIADIRALLQK

SEQ ID NO: 7007 - protein, 14 aa, Artificial Sequence
  Description of Artificial Sequence: Synthetic peptide
HEVSLLSAEGVLRH

SEQ ID NO: 7008 - protein, 14 aa, Artificial Sequence
  Description of Artificial Sequence: Synthetic peptide
LEEAKENLYKAASL

SEQ ID NO: 7009 - protein, 14 aa, Artificial Sequence
  Description of Artificial Sequence: Synthetic peptide
ESKVEALDELVTKK

SEQ ID NO: 7010 - protein, 14 aa, Artificial Sequence
  Description of Artificial Sequence: Synthetic peptide
VRHQRAVENRLREA

SEQ ID NO: 7011 - protein, 14 aa, Artificial Sequence
  Description of Artificial Sequence: Synthetic peptide
AEELSKAVVETVRA

SEQ ID NO: 7012 - protein, 14 aa, Artificial Sequence
  Description of Artificial Sequence: Synthetic peptide
PIRDKEAIRVLSDT

SEQ ID NO: 7013 - protein, 14 aa, Artificial Sequence
  Description of Artificial Sequence: Synthetic peptide
KESIDRIIQVAKET

SEQ ID NO: 7014 - protein, 14 aa, Artificial Sequence
  Description of Artificial Sequence: Synthetic peptide
EKVKGIEELITNYS

SEQ ID NO: 7015 - protein, 14 aa, Artificial Sequence
  Description of Artificial Sequence: Synthetic peptide
AEQKKELSDIALRI

SEQ ID NO: 7016 - protein, 14 aa, Artificial Sequence
  Description of Artificial Sequence: Synthetic peptide
TEHHERAERVFNLL

SEQ ID NO: 7017 - protein, 14 aa, Artificial Sequence
  Description of Artificial Sequence: Synthetic peptide
DANVKRVADLIKES

SEQ ID NO: 7018 - protein, 14 aa, Artificial Sequence
  Description of Artificial Sequence: Synthetic peptide
VESAVTRVKAMMDE

SEQ ID NO: 7019 - protein, 14 aa, Artificial Sequence
  Description of Artificial Sequence: Synthetic peptide
LERQVYELEKLQEK

SEQ ID NO: 7020 - protein, 14 aa, Artificial Sequence
  Description of Artificial Sequence: Synthetic peptide
EENRKAVSDQLKKH

SEQ ID NO: 7021 - protein, 14 aa, Artificial Sequence
  Description of Artificial Sequence: Synthetic peptide
GKNAELISEKILKE

SEQ ID NO: 7022 - protein, 14 aa, Artificial Sequence
  Description of Artificial Sequence: Synthetic peptide
EQLLRKAEAQAKKE

SEQ ID NO: 7023 - protein, 14 aa, Artificial Sequence
  Description of Artificial Sequence: Synthetic peptide
KDNADTLAARAKNA

SEQ ID NO: 7024 - protein, 14 aa, Artificial Sequence
  Description of Artificial Sequence: Synthetic peptide
RTERDKLMQTVAHV

SEQ ID NO: 7025 - protein, 14 aa, Artificial Sequence
  Description of Artificial Sequence: Synthetic peptide
SHDRLRVHQIAEEH

SEQ ID NO: 7026 - protein, 14 aa, Artificial Sequence
  Description of Artificial Sequence: Synthetic peptide
SLVVSELSLKLRKE

SEQ ID NO: 7027 - protein, 14 aa, Artificial Sequence
  Description of Artificial Sequence: Synthetic peptide
IDEGVKIVLEITKS

SEQ ID NO: 7028 - protein, 14 aa, Artificial Sequence
  Description of Artificial Sequence: Synthetic peptide
PRTVEVHRANVMAK

SEQ ID NO: 7029 - protein, 14 aa, Artificial Sequence
  Description of Artificial Sequence: Synthetic peptide
KEVLKESAKTIVDS

SEQ ID NO: 7030 - protein, 14 aa, Artificial Sequence
  Description of Artificial Sequence: Synthetic peptide
NGQLWKKVKDSLID

SEQ ID NO: 7031 - protein, 14 aa, Artificial Sequence
  Description of Artificial Sequence: Synthetic peptide
DVERAIETLIKNFH

SEQ ID NO: 7032 - protein, 14 aa, Artificial Sequence
  Description of Artificial Sequence: Synthetic peptide
EFQDSLKKVEKASL

SEQ ID NO: 7033 - protein, 14 aa, Artificial Sequence
  Description of Artificial Sequence: Synthetic peptide
VDKTFHDLVRVIRQ

SEQ ID NO: 7034 - protein, 14 aa, Artificial Sequence
  Description of Artificial Sequence: Synthetic peptide
ATAQMEEKLRDFTR

SEQ ID NO: 7035 - protein, 14 aa, Artificial Sequence
  Description of Artificial Sequence: Synthetic peptide
PEQKKELSDIAHRI

SEQ ID NO: 7036 - protein, 14 aa, Artificial Sequence
  Description of Artificial Sequence: Synthetic peptide
ETEKVQEFQRLLKE

SEQ ID NO: 7037 - protein, 14 aa, Artificial Sequence
  Description of Artificial Sequence: Synthetic peptide
STTDQREQGFKSEM

SEQ ID NO: 7038 - protein, 14 aa, Artificial Sequence
  Description of Artificial Sequence: Synthetic peptide
DNGEQRKGGALKAF

SEQ ID NO: 7039 - protein, 14 aa, Artificial Sequence
  Description of Artificial Sequence: Synthetic peptide
HADIYDKVSGDMQK

SEQ ID NO: 7040 - protein, 14 aa, Artificial Sequence
  Description of Artificial Sequence: Synthetic peptide
QATRNRVEKAAREV

SEQ ID NO: 7041 - protein, 14 aa, Artificial Sequence
  Description of Artificial Sequence: Synthetic peptide
EAVQKELLAEWKRT

SEQ ID NO: 7042 - protein, 14 aa, Artificial Sequence
  Description of Artificial Sequence: Synthetic peptide
FRAMASDQRELMRT

SEQ ID NO: 7043 - protein, 14 aa, Artificial Sequence
  Description of Artificial Sequence: Synthetic peptide
IDDGLRKTIEWTKA

SEQ ID NO: 7044 - protein, 14 aa, Artificial Sequence
  Description of Artificial Sequence: Synthetic peptide
LADFRQTIDKVDAI

SEQ ID NO: 7045 - protein, 14 aa, Artificial Sequence
  Description of Artificial Sequence: Synthetic peptide
KVTRAIIENEVDKI

SEQ ID NO: 7046 - protein, 14 aa, Artificial Sequence
  Description of Artificial Sequence: Synthetic peptide
SSRLKDVEAGLKII

SEQ ID NO: 7047 - protein, 14 aa, Artificial Sequence
  Description of Artificial Sequence: Synthetic peptide
PVLDEFVNHLNRLR

SEQ ID NO: 7048 - protein, 14 aa, Artificial Sequence
  Description of Artificial Sequence: Synthetic peptide
PKERTEWIKAIQMA

SEQ ID NO: 7049 - protein, 14 aa, Artificial Sequence
  Description of Artificial Sequence: Synthetic peptide
IPQAEKLDQMLKEQ

SEQ ID NO: 7050 - protein, 14 aa, Artificial Sequence
  Description of Artificial Sequence: Synthetic peptide
EKATLEWLKAMKTN

SEQ ID NO: 7051 - protein, 14 aa, Artificial Sequence
  Description of Artificial Sequence: Synthetic peptide
KDLVLSVHNRAIRN

SEQ ID NO: 7052 - protein, 14 aa, Artificial Sequence
  Description of Artificial Sequence: Synthetic peptide
RDDMLAWIKTIQES

SEQ ID NO: 7053 - protein, 14 aa, Artificial Sequence
  Description of Artificial Sequence: Synthetic peptide
QKKADALNAEHIRM

SEQ ID NO: 7054 - protein, 14 aa, Artificial Sequence
  Description of Artificial Sequence: Synthetic peptide
VGDFTVRLRDHLDT

SEQ ID NO: 7055 - protein, 14 aa, Artificial Sequence
  Description of Artificial Sequence: Synthetic peptide
VNSLKKALEELKEK

SEQ ID NO: 7056 - protein, 14 aa, Artificial Sequence
  Description of Artificial Sequence: Synthetic peptide
TYSITKRVKEVLTD

SEQ ID NO: 7057 - protein, 14 aa, Artificial Sequence
  Description of Artificial Sequence: Synthetic peptide
ETALLDWLGTMREK

SEQ ID NO: 7058 - protein, 14 aa, Artificial Sequence
  Description of Artificial Sequence: Synthetic peptide
DNEKNRKLFDLLDV

SEQ ID NO: 7059 - protein, 14 aa, Artificial Sequence
  Description of Artificial Sequence: Synthetic peptide
DPTRERLKAAAQSI

SEQ ID NO: 7060 - protein, 14 aa, Artificial Sequence
  Description of Artificial Sequence: Synthetic peptide
VDEIVENLRKQVKA

SEQ ID NO: 7061 - protein, 14 aa, Artificial Sequence
  Description of Artificial Sequence: Synthetic peptide
VPLTVKEMNRLIDE

SEQ ID NO: 7062 - protein, 14 aa, Artificial Sequence
  Description of Artificial Sequence: Synthetic peptide
AEQVVQGMKEAQER

SEQ ID NO: 7063 - protein, 14 aa, Artificial Sequence
  Description of Artificial Sequence: Synthetic peptide
RELARQTLEVVQEM

SEQ ID NO: 7064 - protein, 14 aa, Artificial Sequence
  Description of Artificial Sequence: Synthetic peptide
AKDVDSRAREVISK

SEQ ID NO: 7065 - protein, 14 aa, Artificial Sequence
  Description of Artificial Sequence: Synthetic peptide
STVREQLKKKLVEV

SEQ ID NO: 7066 - protein, 14 aa, Artificial Sequence
  Description of Artificial Sequence: Synthetic peptide
EKQAKEVLKQHFEK

SEQ ID NO: 7067 - protein, 14 aa, Artificial Sequence
  Description of Artificial Sequence: Synthetic peptide
TVLVHRVHSYLERH

SEQ ID NO: 7068 - protein, 14 aa, Artificial Sequence
  Description of Artificial Sequence: Synthetic peptide
PHHLAQAERNVRAF

SEQ ID NO: 7069 - protein, 14 aa, Artificial Sequence
  Description of Artificial Sequence: Synthetic peptide
VERGITSLHHALEL

SEQ ID NO: 7070 - protein, 14 aa, Artificial Sequence
  Description of Artificial Sequence: Synthetic peptide
DEERKTMMNLMVAA

SEQ ID NO: 7071 - protein, 14 aa, Artificial Sequence
  Description of Artificial Sequence: Synthetic peptide
EGTYRQLIRLHQTE

SEQ ID NO: 7072 - protein, 14 aa, Artificial Sequence
  Description of Artificial Sequence: Synthetic peptide
QNLLDELDNRIIKN

SEQ ID NO: 7073 - protein, 14 aa, Artificial Sequence
  Description of Artificial Sequence: Synthetic peptide
EKTLINKIAELKKF

SEQ ID NO: 7074 - protein, 14 aa, Artificial Sequence
  Description of Artificial Sequence: Synthetic peptide
LDEINKKELSIKEA

SEQ ID NO: 7075 - protein, 14 aa, Artificial Sequence
  Description of Artificial Sequence: Synthetic peptide
KASLNWHQRKHAET

SEQ ID NO: 7076 - protein, 14 aa, Artificial Sequence
  Description of Artificial Sequence: Synthetic peptide
KDTMAKISNELHAI

SEQ ID NO: 7077 - protein, 14 aa, Artificial Sequence
  Description of Artificial Sequence: Synthetic peptide
RDTLERTADEIRAA

SEQ ID NO: 7078 - protein, 14 aa, Artificial Sequence
  Description of Artificial Sequence: Synthetic peptide
PKLTMEYVEQAIKK

SEQ ID NO: 7079 - protein, 14 aa, Artificial Sequence
  Description of Artificial Sequence: Synthetic peptide
PELIQPIQDKIKNE

SEQ ID NO: 7080 - protein, 14 aa, Artificial Sequence
  Description of Artificial Sequence: Synthetic peptide
SKNELSRAFKSLLE

SEQ ID NO: 7081 - protein, 14 aa, Artificial Sequence
  Description of Artificial Sequence: Synthetic peptide
GEAHTRMRRLFNAV

SEQ ID NO: 7082 - protein, 14 aa, Artificial Sequence
  Description of Artificial Sequence: Synthetic peptide
HREHMQRLHDSAKI

SEQ ID NO: 7083 - protein, 14 aa, Artificial Sequence
  Description of Artificial Sequence: Synthetic peptide
PDIEKQVMRQFADT

SEQ ID NO: 7084 - protein, 14 aa, Artificial Sequence
  Description of Artificial Sequence: Synthetic peptide
KSTVTGLVKRLEAD

SEQ ID NO: 7085 - protein, 14 aa, Artificial Sequence
  Description of Artificial Sequence: Synthetic peptide
REKAQELVNAAHEF

SEQ ID NO: 7086 - protein, 14 aa, Artificial Sequence
  Description of Artificial Sequence: Synthetic peptide
VDQKVKSTQDVLKS

SEQ ID NO: 7087 - protein, 14 aa, Artificial Sequence
  Description of Artificial Sequence: Synthetic peptide
DLLQHTANVVKAHK

SEQ ID NO: 7088 - protein, 14 aa, Artificial Sequence
  Description of Artificial Sequence: Synthetic peptide
AKDDRVFQLAVSDL

SEQ ID NO: 7089 - protein, 14 aa, Artificial Sequence
  Description of Artificial Sequence: Synthetic peptide
SADREKLERFSHSE

SEQ ID NO: 7090 - protein, 14 aa, Artificial Sequence
  Description of Artificial Sequence: Synthetic peptide
AETVGRVKRFIQEA

SEQ ID NO: 7091 - protein, 14 aa, Artificial Sequence
  Description of Artificial Sequence: Synthetic peptide
RQKAEQVADEIYQA

SEQ ID NO: 7092 - protein, 14 aa, Artificial Sequence
  Description of Artificial Sequence: Synthetic peptide
VLSKLLRDSHVLHS

SEQ ID NO: 7093 - protein, 14 aa, Artificial Sequence
  Description of Artificial Sequence: Synthetic peptide
IENKAADYLKVSAK

SEQ ID NO: 7094 - protein, 14 aa, Artificial Sequence
  Description of Artificial Sequence: Synthetic peptide
KELRDWIAQTLNDL

SEQ ID NO: 7095 - protein, 14 aa, Artificial Sequence
  Description of Artificial Sequence: Synthetic peptide
ERQIKKQTALVELV

SEQ ID NO: 7096 - protein, 14 aa, Artificial Sequence
  Description of Artificial Sequence: Synthetic peptide
GELGQAVSEGRKKE

SEQ ID NO: 7097 - protein, 14 aa, Artificial Sequence
  Description of Artificial Sequence: Synthetic peptide
EKTGVDKIVEHVKS

SEQ ID NO: 7098 - protein, 14 aa, Artificial Sequence
  Description of Artificial Sequence: Synthetic peptide
AHDRNLASLVEKYL

SEQ ID NO: 7099 - protein, 14 aa, Artificial Sequence
  Description of Artificial Sequence: Synthetic peptide
YNLALDKAIQKLHD

SEQ ID NO: 7100 - protein, 14 aa, Artificial Sequence
  Description of Artificial Sequence: Synthetic peptide
ENTIKTTRRVLELV

SEQ ID NO: 7101 - protein, 14 aa, Artificial Sequence
  Description of Artificial Sequence: Synthetic peptide
LDVRMQLKELAQKE

SEQ ID NO: 7102 - protein, 14 aa, Artificial Sequence
  Description of Artificial Sequence: Synthetic peptide
DDQLKSHVRGALNA

SEQ ID NO: 7103 - protein, 14 aa, Artificial Sequence
  Description of Artificial Sequence: Synthetic peptide
EGQLKLALKTLEKA

SEQ ID NO: 7104 - protein, 14 aa, Artificial Sequence
  Description of Artificial Sequence: Synthetic peptide
ETGKEKLLISKIFT

SEQ ID NO: 7105 - protein, 14 aa, Artificial Sequence
  Description of Artificial Sequence: Synthetic peptide
RLYRELQAVAESLK

SEQ ID NO: 7106 - protein, 14 aa, Artificial Sequence
  Description of Artificial Sequence: Synthetic peptide
NVLTARVLDKLDKY

SEQ ID NO: 7107 - protein, 14 aa, Artificial Sequence
  Description of Artificial Sequence: Synthetic peptide
LNDAMNKATKFLKD

SEQ ID NO: 7108 - protein, 14 aa, Artificial Sequence
  Description of Artificial Sequence: Synthetic peptide
LAAARQHARDVLDQ

SEQ ID NO: 7109 - protein, 14 aa, Artificial Sequence
  Description of Artificial Sequence: Synthetic peptide
QEIQVLRVVKNFEH

SEQ ID NO: 7110 - protein, 14 aa, Artificial Sequence
  Description of Artificial Sequence: Synthetic peptide
TWDLVADIERLRTH

SEQ ID NO: 7111 - protein, 14 aa, Artificial Sequence
  Description of Artificial Sequence: Synthetic peptide
REEAISNMVVALKE

SEQ ID NO: 7112 - protein, 14 aa, Artificial Sequence
  Description of Artificial Sequence: Synthetic peptide
ETYKSNLKIAELKL

SEQ ID NO: 7113 - protein, 15 aa, Artificial Sequence
  Description of Artificial Sequence: Synthetic peptide
EADLSKELAIQVRKV

SEQ ID NO: 7114 - protein, 15 aa, Artificial Sequence
  Description of Artificial Sequence: Synthetic peptide
VEEVNALKNEILKAH

SEQ ID NO: 7115 - protein, 15 aa, Artificial Sequence
  Description of Artificial Sequence: Synthetic peptide
KKITQWLETKGVERL

SEQ ID NO: 7116 - protein, 15 aa, Artificial Sequence
  Description of Artificial Sequence: Synthetic peptide
EDLRTKVENTTKKIF

SEQ ID NO: 7117 - protein, 15 aa, Artificial Sequence
  Description of Artificial Sequence: Synthetic peptide
PTKFAEIVEENLKSA

SEQ ID NO: 7118 - protein, 15 aa, Artificial Sequence
  Description of Artificial Sequence: Synthetic peptide
VFETLKEVSRLVLAR

SEQ ID NO: 7119 - protein, 15 aa, Artificial Sequence
  Description of Artificial Sequence: Synthetic peptide
QIQRELKKLEQRLTA

SEQ ID NO: 7120 - protein, 15 aa, Artificial Sequence
  Description of Artificial Sequence: Synthetic peptide
AKEKTDLVQKFGESL

SEQ ID NO: 7121 - protein, 15 aa, Artificial Sequence
  Description of Artificial Sequence: Synthetic peptide
HRELWAKIANSINDI

SEQ ID NO: 7122 - protein, 15 aa, Artificial Sequence
  Description of Artificial Sequence: Synthetic peptide
WQDISMMRMKTIGEH

SEQ ID NO: 7123 - protein, 15 aa, Artificial Sequence
  Description of Artificial Sequence: Synthetic peptide
TQNLAKFAVDEENKI

SEQ ID NO: 7124 - protein, 15 aa, Artificial Sequence
  Description of Artificial Sequence: Synthetic peptide
SEKAVRELFARARDS

SEQ ID NO: 7125 - protein, 15 aa, Artificial Sequence
  Description of Artificial Sequence: Synthetic peptide
RGTKALMDEVVKATS

SEQ ID NO: 7126 - protein, 15 aa, Artificial Sequence
  Description of Artificial Sequence: Synthetic peptide
LHQAMRAAGDEFETR

SEQ ID NO: 7127 - protein, 15 aa, Artificial Sequence
  Description of Artificial Sequence: Synthetic peptide
LEETKGQINNSIKDL

SEQ ID NO: 7128 - protein, 15 aa, Artificial Sequence
  Description of Artificial Sequence: Synthetic peptide
STEVAERARDLVRAT

SEQ ID NO: 7129 - protein, 15 aa, Artificial Sequence
  Description of Artificial Sequence: Synthetic peptide
RDATLAQAKELWAKV

SEQ ID NO: 7130 - protein, 15 aa, Artificial Sequence
  Description of Artificial Sequence: Synthetic peptide
ERLHNQLKALKQDLA

SEQ ID NO: 7131 - protein, 15 aa, Artificial Sequence
  Description of Artificial Sequence: Synthetic peptide
MDDFIKALRTIKEKS

SEQ ID NO: 7132 - protein, 15 aa, Artificial Sequence
  Description of Artificial Sequence: Synthetic peptide
SDEVQLIKKTWEIPV

SEQ ID NO: 7133 - protein, 15 aa, Artificial Sequence
  Description of Artificial Sequence: Synthetic peptide
PESDKLKSEGNAAMA

SEQ ID NO: 7134 - protein, 15 aa, Artificial Sequence
  Description of Artificial Sequence: Synthetic peptide
VKYKNVAKEVANDIK

SEQ ID NO: 7135 - protein, 15 aa, Artificial Sequence
  Description of Artificial Sequence: Synthetic peptide
RTELLDIAATLFAER

SEQ ID NO: 7136 - protein, 15 aa, Artificial Sequence
  Description of Artificial Sequence: Synthetic peptide
RQLEALIRLSEAHAR

SEQ ID NO: 7137 - protein, 15 aa, Artificial Sequence
  Description of Artificial Sequence: Synthetic peptide
RETKTLIVEAIVRET

SEQ ID NO: 7138 - protein, 15 aa, Artificial Sequence
  Description of Artificial Sequence: Synthetic peptide
ADEVKAMIKEVVSQF

SEQ ID NO: 7139 - protein, 15 aa, Artificial Sequence
  Description of Artificial Sequence: Synthetic peptide
LDEVVAMQKPFVQKH

SEQ ID NO: 7140 - protein, 15 aa, Artificial Sequence
  Description of Artificial Sequence: Synthetic peptide
ASKSISDISFEVDRL

SEQ ID NO: 7141 - protein, 15 aa, Artificial Sequence
  Description of Artificial Sequence: Synthetic peptide
HSTNVLLSLNDQRKK

SEQ ID NO: 7142 - protein, 15 aa, Artificial Sequence
  Description of Artificial Sequence: Synthetic peptide
EETAQKVIKLLNALE

SEQ ID NO: 7143 - protein, 15 aa, Artificial Sequence
  Description of Artificial Sequence: Synthetic peptide
RQALGEAREVIKNLA

SEQ ID NO: 7144 - protein, 15 aa, Artificial Sequence
  Description of Artificial Sequence: Synthetic peptide
ESETKSTLLFGQRAK

SEQ ID NO: 7145 - protein, 15 aa, Artificial Sequence
  Description of Artificial Sequence: Synthetic peptide
AEERKELRTQFQDTT

SEQ ID NO: 7146 - protein, 15 aa, Artificial Sequence
  Description of Artificial Sequence: Synthetic peptide
PDERLKLAQAYKEKT

SEQ ID NO: 7147 - protein, 15 aa, Artificial Sequence
  Description of Artificial Sequence: Synthetic peptide
LSQFRKIVDKVDQTA

SEQ ID NO: 7148 - protein, 15 aa, Artificial Sequence
  Description of Artificial Sequence: Synthetic peptide
DDLHVGLARLWQRLT

SEQ ID NO: 7149 - protein, 15 aa, Artificial Sequence
  Description of Artificial Sequence: Synthetic peptide
DSLMKTQAELLLERL

SEQ ID NO: 7150 - protein, 15 aa, Artificial Sequence
  Description of Artificial Sequence: Synthetic peptide
DRQNKAYKEAMEALK

SEQ ID NO: 7151 - protein, 15 aa, Artificial Sequence
  Description of Artificial Sequence: Synthetic peptide
IDEYRDTLRHLVATT

SEQ ID NO: 7152 - protein, 15 aa, Artificial Sequence
  Description of Artificial Sequence: Synthetic peptide
GEKLYTGLREVVTEH

SEQ ID NO: 7153 - protein, 15 aa, Artificial Sequence
  Description of Artificial Sequence: Synthetic peptide
VQDAVKQIIDYLDTK

SEQ ID NO: 7154 - protein, 15 aa, Artificial Sequence
  Description of Artificial Sequence: Synthetic peptide
DGAVKALETWKTLLD

SEQ ID NO: 7155 - protein, 15 aa, Artificial Sequence
  Description of Artificial Sequence: Synthetic peptide
PETEKVLKYLEATER

SEQ ID NO: 7156 - protein, 15 aa, Artificial Sequence
  Description of Artificial Sequence: Synthetic peptide
HGEISLVLNTLREKE

SEQ ID NO: 7157 - protein, 15 aa, Artificial Sequence
  Description of Artificial Sequence: Synthetic peptide
ANDHIAVLVKKFSLE

SEQ ID NO: 7158 - protein, 15 aa, Artificial Sequence
  Description of Artificial Sequence: Synthetic peptide
PLSLVKKLKKDGLQD

SEQ ID NO: 7159 - protein, 15 aa, Artificial Sequence
  Description of Artificial Sequence: Synthetic peptide
PSDLREKLSELADAK

SEQ ID NO: 7160 - protein, 15 aa, Artificial Sequence
  Description of Artificial Sequence: Synthetic peptide
TGVVRDSMAKLRERL

SEQ ID NO: 7161 - protein, 15 aa, Artificial Sequence
  Description of Artificial Sequence: Synthetic peptide
QRDAENTMRELAVRE

SEQ ID NO: 7162 - protein, 15 aa, Artificial Sequence
  Description of Artificial Sequence: Synthetic peptide
PERVRPALENTLKDL

SEQ ID NO: 7163 - protein, 15 aa, Artificial Sequence
  Description of Artificial Sequence: Synthetic peptide
SESIQKKFQLMKEHV

SEQ ID NO: 7164 - protein, 15 aa, Artificial Sequence
  Description of Artificial Sequence: Synthetic peptide
ENTVNFHQKNMQKKI

SEQ ID NO: 7165 - protein, 15 aa, Artificial Sequence
  Description of Artificial Sequence: Synthetic peptide
DEIKIKLIKTLAFNA

SEQ ID NO: 7166 - protein, 15 aa, Artificial Sequence
  Description of Artificial Sequence: Synthetic peptide
FDTALTDLKTIIRAE

SEQ ID NO: 7167 - protein, 15 aa, Artificial Sequence
  Description of Artificial Sequence: Synthetic peptide
TDDRIKSWVAQLKSE

SEQ ID NO: 7168 - protein, 15 aa, Artificial Sequence
  Description of Artificial Sequence: Synthetic peptide
RLDHNRAISQLAAKT

SEQ ID NO: 7169 - protein, 15 aa, Artificial Sequence
  Description of Artificial Sequence: Synthetic peptide
EKLTFKTDLEKLERE

SEQ ID NO: 7170 - protein, 15 aa, Artificial Sequence
  Description of Artificial Sequence: Synthetic peptide
HHTASESFMKHMQNE

SEQ ID NO: 7171 - protein, 15 aa, Artificial Sequence
  Description of Artificial Sequence: Synthetic peptide
KKLLKEAFQKTLTDL

SEQ ID NO: 7172 - protein, 15 aa, Artificial Sequence
  Description of Artificial Sequence: Synthetic peptide
VDQIRKNYHSLVSQR

SEQ ID NO: 7173 - protein, 15 aa, Artificial Sequence
  Description of Artificial Sequence: Synthetic peptide
DRANFTLLLAELHKA

SEQ ID NO: 7174 - protein, 15 aa, Artificial Sequence
  Description of Artificial Sequence: Synthetic peptide
ESNKENREAHLAAML

SEQ ID NO: 7175 - protein, 15 aa, Artificial Sequence
  Description of Artificial Sequence: Synthetic peptide
HGSDLGKKLLEAANV

SEQ ID NO: 7176 - protein, 15 aa, Artificial Sequence
  Description of Artificial Sequence: Synthetic peptide
AADRLNYLKDLSRSH

SEQ ID NO: 7177 - protein, 15 aa, Artificial Sequence
  Description of Artificial Sequence: Synthetic peptide
KFQEAVEKVTQHIHG

SEQ ID NO: 7178 - protein, 15 aa, Artificial Sequence
  Description of Artificial Sequence: Synthetic peptide
RAAWAAQLAQLREDE

SEQ ID NO: 7179 - protein, 15 aa, Artificial Sequence
  Description of Artificial Sequence: Synthetic peptide
MDEVQNRIKEILDKH

SEQ ID NO: 7180 - protein, 15 aa, Artificial Sequence
  Description of Artificial Sequence: Synthetic peptide
PERVTQAIREWLRKV

SEQ ID NO: 7181 - protein, 15 aa, Artificial Sequence
  Description of Artificial Sequence: Synthetic peptide
NEKVGELQAKALVDI

SEQ ID NO: 7182 - protein, 15 aa, Artificial Sequence
  Description of Artificial Sequence: Synthetic peptide
ANGYLDKLAQELGRK

SEQ ID NO: 7183 - protein, 15 aa, Artificial Sequence
  Description of Artificial Sequence: Synthetic peptide
RQAIFETLVAKGREL

SEQ ID NO: 7184 - protein, 15 aa, Artificial Sequence
  Description of Artificial Sequence: Synthetic peptide
PDQQRDFQREIQILK

SEQ ID NO: 7185 - protein, 15 aa, Artificial Sequence
  Description of Artificial Sequence: Synthetic peptide
VGEVSKLVKKALSNE

SEQ ID NO: 7186 - protein, 15 aa, Artificial Sequence
  Description of Artificial Sequence: Synthetic peptide
PQMVRDTQQLLKETR

SEQ ID NO: 7187 - protein, 15 aa, Artificial Sequence
  Description of Artificial Sequence: Synthetic peptide
LTKHLQVFRDHLINQ

SEQ ID NO: 7188 - protein, 15 aa, Artificial Sequence
  Description of Artificial Sequence: Synthetic peptide
EEMTKQAEKWIKDNL

SEQ ID NO: 7189 - protein, 15 aa, Artificial Sequence
  Description of Artificial Sequence: Synthetic peptide
REERAQLIATARKAV

SEQ ID NO: 7190 - protein, 15 aa, Artificial Sequence
  Description of Artificial Sequence: Synthetic peptide
TESAKEAYVKLLDTL

SEQ ID NO: 7191 - protein, 15 aa, Artificial Sequence
  Description of Artificial Sequence: Synthetic peptide
EKDRNDLITYLKKAT

SEQ ID NO: 7192 - protein, 15 aa, Artificial Sequence
  Description of Artificial Sequence: Synthetic peptide
KADLIATARKTWDER

SEQ ID NO: 7193 - protein, 15 aa, Artificial Sequence
  Description of Artificial Sequence: Synthetic peptide
HEGRAAQKRLETLLE

SEQ ID NO: 7194 - protein, 15 aa, Artificial Sequence
  Description of Artificial Sequence: Synthetic peptide
KEAATAVAKAFEQET

SEQ ID NO: 7195 - protein, 15 aa, Artificial Sequence
  Description of Artificial Sequence: Synthetic peptide
LGHQVASDYLRIMER

SEQ ID NO: 7196 - protein, 15 aa, Artificial Sequence
  Description of Artificial Sequence: Synthetic peptide
VEQNLKHVVTIKREL

SEQ ID NO: 7197 - protein, 15 aa, Artificial Sequence
  Description of Artificial Sequence: Synthetic peptide
MEEHTQVIKEIIRVA

SEQ ID NO: 7198 - protein, 15 aa, Artificial Sequence
  Description of Artificial Sequence: Synthetic peptide
ERQVRIQLKDHIDRT

SEQ ID NO: 7199 - protein, 15 aa, Artificial Sequence
  Description of Artificial Sequence: Synthetic peptide
DEVFGAVKDRQRNLL

SEQ ID NO: 7200 - protein, 15 aa, Artificial Sequence
  Description of Artificial Sequence: Synthetic peptide
LKELDFKIRQQLVNN

SEQ ID NO: 7201 - protein, 15 aa, Artificial Sequence
  Description of Artificial Sequence: Synthetic peptide
TPNEKLLGHLVKEKY

SEQ ID NO: 7202 - protein, 15 aa, Artificial Sequence
  Description of Artificial Sequence: Synthetic peptide
SKEKWNDIDQIATSL

SEQ ID NO: 7203 - protein, 15 aa, Artificial Sequence
  Description of Artificial Sequence: Synthetic peptide
WKEDVKKMIVLSLTR

SEQ ID NO: 7204 - protein, 15 aa, Artificial Sequence
  Description of Artificial Sequence: Synthetic peptide
GRDLTDYLMKILTER

SEQ ID NO: 7205 - protein, 15 aa, Artificial Sequence
  Description of Artificial Sequence: Synthetic peptide
KSLMKEAFQKTLSDL

SEQ ID NO: 7206 - protein, 15 aa, Artificial Sequence
  Description of Artificial Sequence: Synthetic peptide
EAETKSTLMFGQRAK

SEQ ID NO: 7207 - protein, 15 aa, Artificial Sequence
  Description of Artificial Sequence: Synthetic peptide
FKDIKKIMEEKIQIS

SEQ ID NO: 7208 - protein, 15 aa, Artificial Sequence
  Description of Artificial Sequence: Synthetic peptide
DEVRKTNLAGLMDGY

SEQ ID NO: 7209 - protein, 15 aa, Artificial Sequence
  Description of Artificial Sequence: Synthetic peptide
TARLDRLMLERVLEQ

SEQ ID NO: 7210 - protein, 15 aa, Artificial Sequence
  Description of Artificial Sequence: Synthetic peptide
YREAVLRAVDRLNEQ

SEQ ID NO: 7211 - protein, 15 aa, Artificial Sequence
  Description of Artificial Sequence: Synthetic peptide
HGAATANESFKRARA

SEQ ID NO: 7212 - protein, 15 aa, Artificial Sequence
  Description of Artificial Sequence: Synthetic peptide
IKERTIKIGKYIVET

SEQ ID NO: 7213 - protein, 15 aa, Artificial Sequence
  Description of Artificial Sequence: Synthetic peptide
VSDLKKYIAELEVQT

SEQ ID NO: 7214 - protein, 15 aa, Artificial Sequence
  Description of Artificial Sequence: Synthetic peptide
SEEKVALYRHVVSVV

SEQ ID NO: 7215 - protein, 15 aa, Artificial Sequence
  Description of Artificial Sequence: Synthetic peptide
LPIIKDHLNDLYRQA

SEQ ID NO: 7216 - protein, 15 aa, Artificial Sequence
  Description of Artificial Sequence: Synthetic peptide
LATQAVQEIKHSLDH

SEQ ID NO: 7217 - protein, 15 aa, Artificial Sequence
  Description of Artificial Sequence: Synthetic peptide
EKDTVLEVLKSFRRA

SEQ ID NO: 7218 - protein, 15 aa, Artificial Sequence
  Description of Artificial Sequence: Synthetic peptide
EVAYLDRASQLVLRD

SEQ ID NO: 7219 - protein, 15 aa, Artificial Sequence
  Description of Artificial Sequence: Synthetic peptide
GINIRQKVKELVEFA

SEQ ID NO: 7220 - protein, 15 aa, Artificial Sequence
  Description of Artificial Sequence: Synthetic peptide
QALLERIRAKEVQKQ

SEQ ID NO: 7221 - protein, 15 aa, Artificial Sequence
  Description of Artificial Sequence: Synthetic peptide
LMKDLIQTALEEMRQ

SEQ ID NO: 7222 - protein, 15 aa, Artificial Sequence
  Description of Artificial Sequence: Synthetic peptide
QDEVKELNRLLGKVI

SEQ ID NO: 7223 - protein, 15 aa, Artificial Sequence
  Description of Artificial Sequence: Synthetic peptide
RDIDAMKSVAEASHK

SEQ ID NO: 7224 - protein, 15 aa, Artificial Sequence
  Description of Artificial Sequence: Synthetic peptide
EASIAISQARLDEKI

SEQ ID NO: 7225 - protein, 15 aa, Artificial Sequence
  Description of Artificial Sequence: Synthetic peptide
LASRTRHLASVLDKL

SEQ ID NO: 7226 - protein, 15 aa, Artificial Sequence
  Description of Artificial Sequence: Synthetic peptide
PQVTVDKLKRLENDF

SEQ ID NO: 7227 - protein, 15 aa, Artificial Sequence
  Description of Artificial Sequence: Synthetic peptide
GAEANAITREILKDI

SEQ ID NO: 7228 - protein, 15 aa, Artificial Sequence
  Description of Artificial Sequence: Synthetic peptide
PTTSARALRDFVVED

SEQ ID NO: 7229 - protein, 15 aa, Artificial Sequence
  Description of Artificial Sequence: Synthetic peptide
RSDLHATLVDAARAA

SEQ ID NO: 7230 - protein, 15 aa, Artificial Sequence
  Description of Artificial Sequence: Synthetic peptide
RDDAIAWKTALMEAN

SEQ ID NO: 7231 - protein, 15 aa, Artificial Sequence
  Description of Artificial Sequence: Synthetic peptide
LGAFEHNIQTLKDRL

SEQ ID NO: 7232 - protein, 15 aa, Artificial Sequence
  Description of Artificial Sequence: Synthetic peptide
VQASDRLMKELRDIY

SEQ ID NO: 7233 - protein, 15 aa, Artificial Sequence
  Description of Artificial Sequence: Synthetic peptide
LEDLVRYVESKISRT

SEQ ID NO: 7234 - protein, 15 aa, Artificial Sequence
  Description of Artificial Sequence: Synthetic peptide
RGTKSLMDEVVKATS

SEQ ID NO: 7235 - protein, 15 aa, Artificial Sequence
  Description of Artificial Sequence: Synthetic peptide
YKEAVLRAIDGINQR

SEQ ID NO: 7236 - protein, 15 aa, Artificial Sequence
  Description of Artificial Sequence: Synthetic peptide
KDDQAKKVQEHLNKT

SEQ ID NO: 7237 - protein, 15 aa, Artificial Sequence
  Description of Artificial Sequence: Synthetic peptide
REMVDQINRVARQVI

SEQ ID NO: 7238 - protein, 15 aa, Artificial Sequence
  Description of Artificial Sequence: Synthetic peptide
SHVAERQARAAKDEL

SEQ ID NO: 7239 - protein, 15 aa, Artificial Sequence
  Description of Artificial Sequence: Synthetic peptide
DKSLDTFVSKVGEIV

SEQ ID NO: 7240 - protein, 15 aa, Artificial Sequence
  Description of Artificial Sequence: Synthetic peptide
DRTAGVLRDTLDQLY

SEQ ID NO: 7241 - protein, 15 aa, Artificial Sequence
  Description of Artificial Sequence: Synthetic peptide
KLETYLNKVEAEAKA

SEQ ID NO: 7242 - protein, 15 aa, Artificial Sequence
  Description of Artificial Sequence: Synthetic peptide
TEELKNFLKDLLEKA

SEQ ID NO: 7243 - protein, 15 aa, Artificial Sequence
  Description of Artificial Sequence: Synthetic peptide
YKKRLNELITDALIT

SEQ ID NO: 7244 - protein, 15 aa, Artificial Sequence
  Description of Artificial Sequence: Synthetic peptide
IPELRERIKNVAEKT

SEQ ID NO: 7245 - protein, 15 aa, Artificial Sequence
  Description of Artificial Sequence: Synthetic peptide
LTEKAIGDVFSLLEK

SEQ ID NO: 7246 - protein, 15 aa, Artificial Sequence
  Description of Artificial Sequence: Synthetic peptide
DEAINRAAINVGKKR

SEQ ID NO: 7247 - protein, 15 aa, Artificial Sequence
  Description of Artificial Sequence: Synthetic peptide
IAEISRELKTLAREL

SEQ ID NO: 7248 - protein, 15 aa, Artificial Sequence
  Description of Artificial Sequence: Synthetic peptide
ERVQKHLKALTSELA

SEQ ID NO: 7249 - protein, 15 aa, Artificial Sequence
  Description of Artificial Sequence: Synthetic peptide
PKEMKEFLDEHQKMT

SEQ ID NO: 7250 - protein, 15 aa, Artificial Sequence
  Description of Artificial Sequence: Synthetic peptide
EEGREAVSQIAASIK

SEQ ID NO: 7251 - protein, 15 aa, Artificial Sequence
  Description of Artificial Sequence: Synthetic peptide
AADLKAVQDKLKTFV

SEQ ID NO: 7252 - protein, 15 aa, Artificial Sequence
  Description of Artificial Sequence: Synthetic peptide
KDEVKELIWKSSLEV

SEQ ID NO: 7253 - protein, 15 aa, Artificial Sequence
  Description of Artificial Sequence: Synthetic peptide
IIPRTLHQIFEKLTD

SEQ ID NO: 7254 - protein, 15 aa, Artificial Sequence
  Description of Artificial Sequence: Synthetic peptide
IKDVHARLQALAQAH

SEQ ID NO: 7255 - protein, 15 aa, Artificial Sequence
  Description of Artificial Sequence: Synthetic peptide
AHQVQKQTLKEILLK

SEQ ID NO: 7256 - protein, 15 aa, Artificial Sequence
  Description of Artificial Sequence: Synthetic peptide
FKQKIISILEDKKAV

SEQ ID NO: 7257 - protein, 15 aa, Artificial Sequence
  Description of Artificial Sequence: Synthetic peptide
LESSHALAHALKMMR

SEQ ID NO: 7258 - protein, 15 aa, Artificial Sequence
  Description of Artificial Sequence: Synthetic peptide
MVSVVHDLQKAIAEK

SEQ ID NO: 7259 - protein, 15 aa, Artificial Sequence
  Description of Artificial Sequence: Synthetic peptide
AEETLKALKGSVKDL

SEQ ID NO: 7260 - protein, 15 aa, Artificial Sequence
  Description of Artificial Sequence: Synthetic peptide
HWNRLRDDAANLKSK

SEQ ID NO: 7261 - protein, 15 aa, Artificial Sequence
  Description of Artificial Sequence: Synthetic peptide
FVENVMKKAIDSLKE

SEQ ID NO: 7262 - protein, 15 aa, Artificial Sequence
  Description of Artificial Sequence: Synthetic peptide
EELVKWGKRVAAANS

SEQ ID NO: 7263 - protein, 15 aa, Artificial Sequence
  Description of Artificial Sequence: Synthetic peptide
KSRLIDRASQLLEVI

SEQ ID NO: 7264 - protein, 15 aa, Artificial Sequence
  Description of Artificial Sequence: Synthetic peptide
RESVHRLVENVAERF

SEQ ID NO: 7265 - protein, 15 aa, Artificial Sequence
  Description of Artificial Sequence: Synthetic peptide
TPDGIIKADKVFNKV

SEQ ID NO: 7266 - protein, 15 aa, Artificial Sequence
  Description of Artificial Sequence: Synthetic peptide
YDDTVRLTMQHAQQH

SEQ ID NO: 7267 - protein, 15 aa, Artificial Sequence
  Description of Artificial Sequence: Synthetic peptide
ARVRNQFLKEMDGLA

SEQ ID NO: 7268 - protein, 15 aa, Artificial Sequence
  Description of Artificial Sequence: Synthetic peptide
LADFRQTIDKVDAIA

SEQ ID NO: 7269 - protein, 15 aa, Artificial Sequence
  Description of Artificial Sequence: Synthetic peptide
EVKLLVERMMALQTD

SEQ ID NO: 7270 - protein, 15 aa, Artificial Sequence
  Description of Artificial Sequence: Synthetic peptide
VKDRLADIKSEIDLT

SEQ ID NO: 7271 - protein, 15 aa, Artificial Sequence
  Description of Artificial Sequence: Synthetic peptide
RDHWKRVMQGHAGAN

SEQ ID NO: 7272 - protein, 15 aa, Artificial Sequence
  Description of Artificial Sequence: Synthetic peptide
GRAVNHIKSVWKDLL

SEQ ID NO: 7273 - protein, 15 aa, Artificial Sequence
  Description of Artificial Sequence: Synthetic peptide
TLIDQAKDRIQKTKS

SEQ ID NO: 7274 - protein, 15 aa, Artificial Sequence
  Description of Artificial Sequence: Synthetic peptide
VEEWLTHARKVTQEA

SEQ ID NO: 7275 - protein, 15 aa, Artificial Sequence
  Description of Artificial Sequence: Synthetic peptide
HREHMQRLHDSAKIY

SEQ ID NO: 7276 - protein, 15 aa, Artificial Sequence
  Description of Artificial Sequence: Synthetic peptide
LQAVLKEDQEKLKLL

SEQ ID NO: 7277 - protein, 15 aa, Artificial Sequence
  Description of Artificial Sequence: Synthetic peptide
SPMAEALFKSIAERE

SEQ ID NO: 7278 - protein, 15 aa, Artificial Sequence
  Description of Artificial Sequence: Synthetic peptide
REEVIKTLVDMVAKS

SEQ ID NO: 7279 - protein, 15 aa, Artificial Sequence
  Description of Artificial Sequence: Synthetic peptide
QLEKLMENMRNDIAS

SEQ ID NO: 7280 - protein, 15 aa, Artificial Sequence
  Description of Artificial Sequence: Synthetic peptide
RDQVKQILVEMVAKS

SEQ ID NO: 7281 - protein, 15 aa, Artificial Sequence
  Description of Artificial Sequence: Synthetic peptide
LDTLKKDIALGQEFV

SEQ ID NO: 7282 - protein, 15 aa, Artificial Sequence
  Description of Artificial Sequence: Synthetic peptide
PAELRAAGRADLTTR

SEQ ID NO: 7283 - protein, 15 aa, Artificial Sequence
  Description of Artificial Sequence: Synthetic peptide
MSAVSLKIVEKAKEA

SEQ ID NO: 7284 - protein, 15 aa, Artificial Sequence
  Description of Artificial Sequence: Synthetic peptide
LKGEVESIKKQINRQ

SEQ ID NO: 7285 - protein, 15 aa, Artificial Sequence
  Description of Artificial Sequence: Synthetic peptide
LNAFRELRTQLEKAL

SEQ ID NO: 7286 - protein, 15 aa, Artificial Sequence
  Description of Artificial Sequence: Synthetic peptide
AQEIDLKVRKFLIAQ

SEQ ID NO: 7287 - protein, 15 aa, Artificial Sequence
  Description of Artificial Sequence: Synthetic peptide
HTALKDIANKYSEKT

SEQ ID NO: 7288 - protein, 15 aa, Artificial Sequence
  Description of Artificial Sequence: Synthetic peptide
KALDKVEKVLVSAQQ

SEQ ID NO: 7289 - protein, 15 aa, Artificial Sequence
  Description of Artificial Sequence: Synthetic peptide
HDHAVVSGRLAGENM

SEQ ID NO: 7290 - protein, 15 aa, Artificial Sequence
  Description of Artificial Sequence: Synthetic peptide
SEDAVNMARVLALKE

SEQ ID NO: 7291 - protein, 15 aa, Artificial Sequence
  Description of Artificial Sequence: Synthetic peptide
EADIERTIAAARTVL

SEQ ID NO: 7292 - protein, 15 aa, Artificial Sequence
  Description of Artificial Sequence: Synthetic peptide
RTEAANVEKITTKLL

SEQ ID NO: 7293 - protein, 15 aa, Artificial Sequence
  Description of Artificial Sequence: Synthetic peptide
GKNAELISEKILKEM

SEQ ID NO: 7294 - protein, 15 aa, Artificial Sequence
  Description of Artificial Sequence: Synthetic peptide
KTTVINEVYHRLVKD

SEQ ID NO: 7295 - protein, 15 aa, Artificial Sequence
  Description of Artificial Sequence: Synthetic peptide
RSHLHDALVNRARAL

SEQ ID NO: 7296 - protein, 15 aa, Artificial Sequence
  Description of Artificial Sequence: Synthetic peptide
IMQILTRVNDRVARH

SEQ ID NO: 7297 - protein, 15 aa, Artificial Sequence
  Description of Artificial Sequence: Synthetic peptide
PLGDANETKALKRAF

SEQ ID NO: 7298 - protein, 15 aa, Artificial Sequence
  Description of Artificial Sequence: Synthetic peptide
NWQKQMLDRLNEAVK

SEQ ID NO: 7299 - protein, 15 aa, Artificial Sequence
  Description of Artificial Sequence: Synthetic peptide
DRLRQFIGELATLLD

SEQ ID NO: 7300 - protein, 15 aa, Artificial Sequence
  Description of Artificial Sequence: Synthetic peptide
NGHALLMTDTRKRLL

SEQ ID NO: 7301 - protein, 15 aa, Artificial Sequence
  Description of Artificial Sequence: Synthetic peptide
MGAILETQRELREVL

SEQ ID NO: 7302 - protein, 15 aa, Artificial Sequence
  Description of Artificial Sequence: Synthetic peptide
HDAFIASVDESLRKL

SEQ ID NO: 7303 - protein, 15 aa, Artificial Sequence
  Description of Artificial Sequence: Synthetic peptide
KLTFKTDLEKLEREK

SEQ ID NO: 7304 - protein, 15 aa, Artificial Sequence
  Description of Artificial Sequence: Synthetic peptide
PHVLRHAFATHLLNH

SEQ ID NO: 7305 - protein, 15 aa, Artificial Sequence
  Description of Artificial Sequence: Synthetic peptide
LDQIDQRIAAVFHHL

SEQ ID NO: 7306 - protein, 15 aa, Artificial Sequence
  Description of Artificial Sequence: Synthetic peptide
RETLEISYRNAIARL

SEQ ID NO: 7307 - protein, 15 aa, Artificial Sequence
  Description of Artificial Sequence: Synthetic peptide
ADARKKLEDSAELLT

SEQ ID NO: 7308 - protein, 15 aa, Artificial Sequence
  Description of Artificial Sequence: Synthetic peptide
SEAVVRLAEASQDRY

SEQ ID NO: 7309 - protein, 15 aa, Artificial Sequence
  Description of Artificial Sequence: Synthetic peptide
KDKFHQLLHELVEKN

SEQ ID NO: 7310 - protein, 15 aa, Artificial Sequence
  Description of Artificial Sequence: Synthetic peptide
PQKAMEEYKEKLKAQ

SEQ ID NO: 7311 - protein, 15 aa, Artificial Sequence
  Description of Artificial Sequence: Synthetic peptide
DAETLSTLRFGMRAK

SEQ ID NO: 7312 - protein, 15 aa, Artificial Sequence
  Description of Artificial Sequence: Synthetic peptide
IYEQIVQKIKEQVVK

SEQ ID NO: 7313 - protein, 15 aa, Artificial Sequence
  Description of Artificial Sequence: Synthetic peptide
REGVKELARQTAELL

SEQ ID NO: 7314 - protein, 15 aa, Artificial Sequence
  Description of Artificial Sequence: Synthetic peptide
KDKLAEISYEAVKSV

SEQ ID NO: 7315 - protein, 15 aa, Artificial Sequence
  Description of Artificial Sequence: Synthetic peptide
QEADTLRFVSALRAR

SEQ ID NO: 7316 - protein, 15 aa, Artificial Sequence
  Description of Artificial Sequence: Synthetic peptide
LEHLAERIANRINSQ

SEQ ID NO: 7317 - protein, 15 aa, Artificial Sequence
  Description of Artificial Sequence: Synthetic peptide
RAKLLNVGFQEALKD

SEQ ID NO: 7318 - protein, 15 aa, Artificial Sequence
  Description of Artificial Sequence: Synthetic peptide
IAQARKLVEQLKMEA

SEQ ID NO: 7319 - protein, 15 aa, Artificial Sequence
  Description of Artificial Sequence: Synthetic peptide
PIVEKILQYRELTKL

SEQ ID NO: 7320 - protein, 15 aa, Artificial Sequence
  Description of Artificial Sequence: Synthetic peptide
PRLREAIAQKLQRDN

SEQ ID NO: 7321 - protein, 15 aa, Artificial Sequence
  Description of Artificial Sequence: Synthetic peptide
THKLADDVLQLLDNR

SEQ ID NO: 7322 - protein, 15 aa, Artificial Sequence
  Description of Artificial Sequence: Synthetic peptide
VEKVLKTRYHDATSK

SEQ ID NO: 7323 - protein, 15 aa, Artificial Sequence
  Description of Artificial Sequence: Synthetic peptide
DDQARHLADLTRLGM

SEQ ID NO: 7324 - protein, 15 aa, Artificial Sequence
  Description of Artificial Sequence: Synthetic peptide
VAESKKLLKKIFDQL

SEQ ID NO: 7325 - protein, 15 aa, Artificial Sequence
  Description of Artificial Sequence: Synthetic peptide
EKALELAVAQIEKSY

SEQ ID NO: 7326 - protein, 15 aa, Artificial Sequence
  Description of Artificial Sequence: Synthetic peptide
HHHHMQQIQRDIAQA

SEQ ID NO: 7327 - protein, 15 aa, Artificial Sequence
  Description of Artificial Sequence: Synthetic peptide
LKKGIDLFEQILKQL

SEQ ID NO: 7328 - protein, 15 aa, Artificial Sequence
  Description of Artificial Sequence: Synthetic peptide
SKGGNLIADELAEKY

SEQ ID NO: 7329 - protein, 15 aa, Artificial Sequence
  Description of Artificial Sequence: Synthetic peptide
GDKELEWLIGRSLIQ

SEQ ID NO: 7330 - protein, 15 aa, Artificial Sequence
  Description of Artificial Sequence: Synthetic peptide
RDQVFAAVEQARKTL

SEQ ID NO: 7331 - protein, 15 aa, Artificial Sequence
  Description of Artificial Sequence: Synthetic peptide
HSEIIIKAFNRVVDK

SEQ ID NO: 7332 - protein, 15 aa, Artificial Sequence
  Description of Artificial Sequence: Synthetic peptide
RDQFRSTLADAAKTL

SEQ ID NO: 7333 - protein, 15 aa, Artificial Sequence
  Description of Artificial Sequence: Synthetic peptide
KEFITNRINDTVKKA

SEQ ID NO: 7334 - protein, 15 aa, Artificial Sequence
  Description of Artificial Sequence: Synthetic peptide
ALESKAKVDQLAQDY

SEQ ID NO: 7335 - protein, 15 aa, Artificial Sequence
  Description of Artificial Sequence: Synthetic peptide
WEHAIDTARDLKNIL

SEQ ID NO: 7336 - protein, 15 aa, Artificial Sequence
  Description of Artificial Sequence: Synthetic peptide
TGEHLEVLSKLAGKF

SEQ ID NO: 7337 - protein, 15 aa, Artificial Sequence
  Description of Artificial Sequence: Synthetic peptide
EKSVMDGAKAVLDTL

SEQ ID NO: 7338 - protein, 15 aa, Artificial Sequence
  Description of Artificial Sequence: Synthetic peptide
EHTRLRGLVSDAFTR

SEQ ID NO: 7339 - protein, 15 aa, Artificial Sequence
  Description of Artificial Sequence: Synthetic peptide
TDDVKSIVRFVQEHS

SEQ ID NO: 7340 - protein, 15 aa, Artificial Sequence
  Description of Artificial Sequence: Synthetic peptide
AEDVKVLKSVKKQIS

SEQ ID NO: 7341 - protein, 15 aa, Artificial Sequence
  Description of Artificial Sequence: Synthetic peptide
EKDRNDLITYLKKAS

SEQ ID NO: 7342 - protein, 15 aa, Artificial Sequence
  Description of Artificial Sequence: Synthetic peptide
ISDKLMVHLVERVQR

SEQ ID NO: 7343 - protein, 15 aa, Artificial Sequence
  Description of Artificial Sequence: Synthetic peptide
RVGFDALLREHVSTH

SEQ ID NO: 7344 - protein, 15 aa, Artificial Sequence
  Description of Artificial Sequence: Synthetic peptide
GSHMAVSKVMEKILR

SEQ ID NO: 7345 - protein, 15 aa, Artificial Sequence
  Description of Artificial Sequence: Synthetic peptide
EASRKSLYDLTKSLV

SEQ ID NO: 7346 - protein, 15 aa, Artificial Sequence
  Description of Artificial Sequence: Synthetic peptide
EAQKTLAEEVTKFIH

SEQ ID NO: 7347 - protein, 15 aa, Artificial Sequence
  Description of Artificial Sequence: Synthetic peptide
MEVLKRVLKSMDETA

SEQ ID NO: 7348 - protein, 15 aa, Artificial Sequence
  Description of Artificial Sequence: Synthetic peptide
PGEFKTLISKERKSH

SEQ ID NO: 7349 - protein, 15 aa, Artificial Sequence
  Description of Artificial Sequence: Synthetic peptide
ASGEARRNGATEAFK

SEQ ID NO: 7350 - protein, 15 aa, Artificial Sequence
  Description of Artificial Sequence: Synthetic peptide
NAEALILEMNLIKKH

SEQ ID NO: 7351 - protein, 15 aa, Artificial Sequence
  Description of Artificial Sequence: Synthetic peptide
EKALELAMAQIDKNF

SEQ ID NO: 7352 - protein, 15 aa, Artificial Sequence
  Description of Artificial Sequence: Synthetic peptide
YGDLKARVDQVRQAT

SEQ ID NO: 7353 - protein, 15 aa, Artificial Sequence
  Description of Artificial Sequence: Synthetic peptide
LKETIDDTASQILKF

SEQ ID NO: 7354 - protein, 15 aa, Artificial Sequence
  Description of Artificial Sequence: Synthetic peptide
EIAKETQARVLETIL

SEQ ID NO: 7355 - protein, 15 aa, Artificial Sequence
  Description of Artificial Sequence: Synthetic peptide
VQLDTAVVRALRERF

SEQ ID NO: 7356 - protein, 15 aa, Artificial Sequence
  Description of Artificial Sequence: Synthetic peptide
NKEGLELLKTAIGKA

SEQ ID NO: 7357 - protein, 15 aa, Artificial Sequence
  Description of Artificial Sequence: Synthetic peptide
LSTAQKIIKEARDAL

SEQ ID NO: 7358 - protein, 15 aa, Artificial Sequence
  Description of Artificial Sequence: Synthetic peptide
PLSLVRDHRAKDVLT

SEQ ID NO: 7359 - protein, 15 aa, Artificial Sequence
  Description of Artificial Sequence: Synthetic peptide
RKSIKQLAEVAEREM

SEQ ID NO: 7360 - protein, 15 aa, Artificial Sequence
  Description of Artificial Sequence: Synthetic peptide
RSDLNARILKSVVDQ

SEQ ID NO: 7361 - protein, 15 aa, Artificial Sequence
  Description of Artificial Sequence: Synthetic peptide
EIAKETQARVLEAIL

SEQ ID NO: 7362 - protein, 15 aa, Artificial Sequence
  Description of Artificial Sequence: Synthetic peptide
EKVESEIKKVENFLR

SEQ ID NO: 7363 - protein, 15 aa, Artificial Sequence
  Description of Artificial Sequence: Synthetic peptide
QALREAIAQKTERLY

SEQ ID NO: 7364 - protein, 15 aa, Artificial Sequence
  Description of Artificial Sequence: Synthetic peptide
KLDAQIKNISDALGK

SEQ ID NO: 7365 - protein, 15 aa, Artificial Sequence
  Description of Artificial Sequence: Synthetic peptide
EKLDAQIKNISDALG

SEQ ID NO: 7366 - protein, 15 aa, Artificial Sequence
  Description of Artificial Sequence: Synthetic peptide
DQHRQELVNWVDKVG

SEQ ID NO: 7367 - protein, 15 aa, Artificial Sequence
  Description of Artificial Sequence: Synthetic peptide
REEAISNMVVALKEL

SEQ ID NO: 7368 - protein, 15 aa, Artificial Sequence
  Description of Artificial Sequence: Synthetic peptide
KETVEAWSARIKEQL

SEQ ID NO: 7369 - protein, 15 aa, Artificial Sequence
  Description of Artificial Sequence: Synthetic peptide
GQQEAARAGELLKEK

SEQ ID NO: 7370 - protein, 15 aa, Artificial Sequence
  Description of Artificial Sequence: Synthetic peptide
KETKGHIFRAVENAL

SEQ ID NO: 7371 - protein, 15 aa, Artificial Sequence
  Description of Artificial Sequence: Synthetic peptide
SKVIIDRVTEYLESH

SEQ ID NO: 7372 - protein, 15 aa, Artificial Sequence
  Description of Artificial Sequence: Synthetic peptide
SVIGREAKAQILEAE

SEQ ID NO: 7373 - protein, 15 aa, Artificial Sequence
  Description of Artificial Sequence: Synthetic peptide
TYEMNRIQDAIKKLN

SEQ ID NO: 7374 - protein, 15 aa, Artificial Sequence
  Description of Artificial Sequence: Synthetic peptide
WVDKVKDLTKSEMNI

SEQ ID NO: 7375 - protein, 15 aa, Artificial Sequence
  Description of Artificial Sequence: Synthetic peptide
REELTAVMRFLTQRL

SEQ ID NO: 7376 - protein, 15 aa, Artificial Sequence
  Description of Artificial Sequence: Synthetic peptide
VDDIVTKIKSYTTEQ

SEQ ID NO: 7377 - protein, 15 aa, Artificial Sequence
  Description of Artificial Sequence: Synthetic peptide
LPDVDRAVLRTQAKL

SEQ ID NO: 7378 - protein, 15 aa, Artificial Sequence
  Description of Artificial Sequence: Synthetic peptide
RPEREKLMQTVSSMF

SEQ ID NO: 7379 - protein, 15 aa, Artificial Sequence
  Description of Artificial Sequence: Synthetic peptide
YKIATSIDKAIDRIL

SEQ ID NO: 7380 - protein, 15 aa, Artificial Sequence
  Description of Artificial Sequence: Synthetic peptide
EKDVQTALALAKGKF

SEQ ID NO: 7381 - protein, 15 aa, Artificial Sequence
  Description of Artificial Sequence: Synthetic peptide
REKALELAMAQIDKN

SEQ ID NO: 7382 - protein, 15 aa, Artificial Sequence
  Description of Artificial Sequence: Synthetic peptide
VIMDLIQRTKDAVRE

SEQ ID NO: 7383 - protein, 15 aa, Artificial Sequence
  Description of Artificial Sequence: Synthetic peptide
IKKVRASVLYNQDEH

SEQ ID NO: 7384 - protein, 15 aa, Artificial Sequence
  Description of Artificial Sequence: Synthetic peptide
KDDVYEISKLILKSI

SEQ ID NO: 7385 - protein, 15 aa, Artificial Sequence
  Description of Artificial Sequence: Synthetic peptide
PEAATRAVFKVLSRE

SEQ ID NO: 7386 - protein, 15 aa, Artificial Sequence
  Description of Artificial Sequence: Synthetic peptide
TVEMLVKVISEHKNR

SEQ ID NO: 7387 - protein, 15 aa, Artificial Sequence
  Description of Artificial Sequence: Synthetic peptide
LESAIQKVVEKISHR

SEQ ID NO: 7388 - protein, 15 aa, Artificial Sequence
  Description of Artificial Sequence: Synthetic peptide
PEIINEMTRMRMEML

SEQ ID NO: 7389 - protein, 15 aa, Artificial Sequence
  Description of Artificial Sequence: Synthetic peptide
RGQFDLLLLKHAEEQ

SEQ ID NO: 7390 - protein, 15 aa, Artificial Sequence
  Description of Artificial Sequence: Synthetic peptide
PELKAKMETLKEVIT

SEQ ID NO: 7391 - protein, 15 aa, Artificial Sequence
  Description of Artificial Sequence: Synthetic peptide
NLDSARFRHLMGEKL

SEQ ID NO: 7392 - protein, 15 aa, Artificial Sequence
  Description of Artificial Sequence: Synthetic peptide
TDVANEIEKKIKEKL

SEQ ID NO: 7393 - protein, 15 aa, Artificial Sequence
  Description of Artificial Sequence: Synthetic peptide
RLDHNRALSQIAAKT

SEQ ID NO: 7394 - protein, 15 aa, Artificial Sequence
  Description of Artificial Sequence: Synthetic peptide
PEHTIAAAKVILKKS

SEQ ID NO: 7395 - protein, 15 aa, Artificial Sequence
  Description of Artificial Sequence: Synthetic peptide
KNARNDFLKEVKIMS

SEQ ID NO: 7396 - protein, 15 aa, Artificial Sequence
  Description of Artificial Sequence: Synthetic peptide
EKAVEKVEKQVNDAV

SEQ ID NO: 7397 - protein, 15 aa, Artificial Sequence
  Description of Artificial Sequence: Synthetic peptide
KDKIIDNAITLFSEK

SEQ ID NO: 7398 - protein, 15 aa, Artificial Sequence
  Description of Artificial Sequence: Synthetic peptide
LKDAINEALRDWVAT

SEQ ID NO: 7399 - protein, 15 aa, Artificial Sequence
  Description of Artificial Sequence: Synthetic peptide
THADHARSFHALHQT

SEQ ID NO: 7400 - protein, 15 aa, Artificial Sequence
  Description of Artificial Sequence: Synthetic peptide
DEISDTLRTRLVALT

SEQ ID NO: 7401 - protein, 15 aa, Artificial Sequence
  Description of Artificial Sequence: Synthetic peptide
LKSTFDDIKKIISKQ

SEQ ID NO: 7402 - protein, 15 aa, Artificial Sequence
  Description of Artificial Sequence: Synthetic peptide
DEQRKLLKEAQAEHN

SEQ ID NO: 7403 - protein, 15 aa, Artificial Sequence
  Description of Artificial Sequence: Synthetic peptide
TNAMQDIATQFKKEK

SEQ ID NO: 7404 - protein, 15 aa, Artificial Sequence
  Description of Artificial Sequence: Synthetic peptide
GGINRKRALLELEKS

SEQ ID NO: 7405 - protein, 15 aa, Artificial Sequence
  Description of Artificial Sequence: Synthetic peptide
AKERASLMKAHGETG

SEQ ID NO: 7406 - protein, 15 aa, Artificial Sequence
  Description of Artificial Sequence: Synthetic peptide
MRERIEFLNEASVMK

SEQ ID NO: 7407 - protein, 15 aa, Artificial Sequence
  Description of Artificial Sequence: Synthetic peptide
RPRITELVGQLLDEL

SEQ ID NO: 7408 - protein, 15 aa, Artificial Sequence
  Description of Artificial Sequence: Synthetic peptide
MTLAKQEAKLVHEKI

SEQ ID NO: 7409 - protein, 15 aa, Artificial Sequence
  Description of Artificial Sequence: Synthetic peptide
VKEAQAAAEQLKTTR

SEQ ID NO: 7410 - protein, 15 aa, Artificial Sequence
  Description of Artificial Sequence: Synthetic peptide
EKSALAYLEKHTARL

SEQ ID NO: 7411 - protein, 15 aa, Artificial Sequence
  Description of Artificial Sequence: Synthetic peptide
EVIDKIQKKTREFLN

SEQ ID NO: 7412 - protein, 15 aa, Artificial Sequence
  Description of Artificial Sequence: Synthetic peptide
SERYGRVILDRVEQR

SEQ ID NO: 7413 - protein, 15 aa, Artificial Sequence
  Description of Artificial Sequence: Synthetic peptide
KVDRILALAETNAEL

SEQ ID NO: 7414 - protein, 15 aa, Artificial Sequence
  Description of Artificial Sequence: Synthetic peptide
AGTKERMRDILREIQ

SEQ ID NO: 7415 - protein, 15 aa, Artificial Sequence
  Description of Artificial Sequence: Synthetic peptide
SNKENREAHLAAMLE

SEQ ID NO: 7416 - protein, 15 aa, Artificial Sequence
  Description of Artificial Sequence: Synthetic peptide
KLHSQANLMRLKSDL

SEQ ID NO: 7417 - protein, 15 aa, Artificial Sequence
  Description of Artificial Sequence: Synthetic peptide
GASRVRDLFETAKKQ

SEQ ID NO: 7418 - protein, 15 aa, Artificial Sequence
  Description of Artificial Sequence: Synthetic peptide
AESIVREFVQEAVRK

SEQ ID NO: 7419 - protein, 15 aa, Artificial Sequence
  Description of Artificial Sequence: Synthetic peptide
SQNRGRELVEKMKDL

SEQ ID NO: 7420 - protein, 15 aa, Artificial Sequence
  Description of Artificial Sequence: Synthetic peptide
RAQRKLALTTIIEHT

SEQ ID NO: 7421 - protein, 15 aa, Artificial Sequence
  Description of Artificial Sequence: Synthetic peptide
LEALESNLKKLGDWL

SEQ ID NO: 7422 - protein, 15 aa, Artificial Sequence
  Description of Artificial Sequence: Synthetic peptide
FRDLALRVDQIRDNM

SEQ ID NO: 7423 - protein, 15 aa, Artificial Sequence
  Description of Artificial Sequence: Synthetic peptide
TDEKERILKTVIDLV

SEQ ID NO: 7424 - protein, 15 aa, Artificial Sequence
  Description of Artificial Sequence: Synthetic peptide
PKERTEWIKAIQMAS

SEQ ID NO: 7425 - protein, 15 aa, Artificial Sequence
  Description of Artificial Sequence: Synthetic peptide
EATLQAMDEKLRKWK

SEQ ID NO: 7426 - protein, 15 aa, Artificial Sequence
  Description of Artificial Sequence: Synthetic peptide
LETVAELIASKTLEK

SEQ ID NO: 7427 - protein, 15 aa, Artificial Sequence
  Description of Artificial Sequence: Synthetic peptide
IHEGLKLANEQIQKA

SEQ ID NO: 7428 - protein, 15 aa, Artificial Sequence
  Description of Artificial Sequence: Synthetic peptide
PAQADLEFLENAKKL

SEQ ID NO: 7429 - protein, 15 aa, Artificial Sequence
  Description of Artificial Sequence: Synthetic peptide
VELRDELAAYITKQT

SEQ ID NO: 7430 - protein, 15 aa, Artificial Sequence
  Description of Artificial Sequence: Synthetic peptide
TNNRMELKAAIEGLK

SEQ ID NO: 7431 - protein, 15 aa, Artificial Sequence
  Description of Artificial Sequence: Synthetic peptide
DKAIDNTVRRANTIT

SEQ ID NO: 7432 - protein, 15 aa, Artificial Sequence
  Description of Artificial Sequence: Synthetic peptide
EKDRNDLITYMTKAA

SEQ ID NO: 7433 - protein, 15 aa, Artificial Sequence
  Description of Artificial Sequence: Synthetic peptide
EATVKTHLVHIYSKL

SEQ ID NO: 7434 - protein, 15 aa, Artificial Sequence
  Description of Artificial Sequence: Synthetic peptide
SREMRLVASYLKEAQ

SEQ ID NO: 7435 - protein, 15 aa, Artificial Sequence
  Description of Artificial Sequence: Synthetic peptide
AQELDIKARNFLINK

SEQ ID NO: 7436 - protein, 15 aa, Artificial Sequence
  Description of Artificial Sequence: Synthetic peptide
ERKDFIKTTVKELIS

SEQ ID NO: 7437 - protein, 15 aa, Artificial Sequence
  Description of Artificial Sequence: Synthetic peptide
EGDLFTQLRKIVKMA

SEQ ID NO: 7438 - protein, 15 aa, Artificial Sequence
  Description of Artificial Sequence: Synthetic peptide
KPLNNFAAEVGKIRD

SEQ ID NO: 7439 - protein, 15 aa, Artificial Sequence
  Description of Artificial Sequence: Synthetic peptide
KEFIRKIVQAKQSAD

SEQ ID NO: 7440 - protein, 15 aa, Artificial Sequence
  Description of Artificial Sequence: Synthetic peptide
RKELETFIKNGIDST

SEQ ID NO: 7441 - protein, 15 aa, Artificial Sequence
  Description of Artificial Sequence: Synthetic peptide
LRTRMGHTMALERLA

SEQ ID NO: 7442 - protein, 15 aa, Artificial Sequence
  Description of Artificial Sequence: Synthetic peptide
TEKVVFQETKAIADN

SEQ ID NO: 7443 - protein, 15 aa, Artificial Sequence
  Description of Artificial Sequence: Synthetic peptide
IVQALEETFRIGREL

SEQ ID NO: 7444 - protein, 15 aa, Artificial Sequence
  Description of Artificial Sequence: Synthetic peptide
SNVVRELIERVSDKL

SEQ ID NO: 7445 - protein, 15 aa, Artificial Sequence
  Description of Artificial Sequence: Synthetic peptide
SSDVVSYVRDQLRKH

SEQ ID NO: 7446 - protein, 15 aa, Artificial Sequence
  Description of Artificial Sequence: Synthetic peptide
PLVTKVHMEVARASR

SEQ ID NO: 7447 - protein, 15 aa, Artificial Sequence
  Description of Artificial Sequence: Synthetic peptide
LSVMKETYETVMKKG

SEQ ID NO: 7448 - protein, 15 aa, Artificial Sequence
  Description of Artificial Sequence: Synthetic peptide
RDKLNMQLQRIIDEA

SEQ ID NO: 7449 - protein, 15 aa, Artificial Sequence
  Description of Artificial Sequence: Synthetic peptide
VQATDRLMKELRDIY

SEQ ID NO: 7450 - protein, 15 aa, Artificial Sequence
  Description of Artificial Sequence: Synthetic peptide
RDEVVNTRFSALLKE

SEQ ID NO: 7451 - protein, 15 aa, Artificial Sequence
  Description of Artificial Sequence: Synthetic peptide
EEGSAYNEKLIPISR

SEQ ID NO: 7452 - protein, 15 aa, Artificial Sequence
  Description of Artificial Sequence: Synthetic peptide
WTKASQQINQHVKDK

SEQ ID NO: 7453 - protein, 15 aa, Artificial Sequence
  Description of Artificial Sequence: Synthetic peptide
DEVKIKVLQRLSIAS

SEQ ID NO: 7454 - protein, 15 aa, Artificial Sequence
  Description of Artificial Sequence: Synthetic peptide
RAEAEAEVQRSVERF

SEQ ID NO: 7455 - protein, 15 aa, Artificial Sequence
  Description of Artificial Sequence: Synthetic peptide
AEVRQATAEAERAVA

SEQ ID NO: 7456 - protein, 15 aa, Artificial Sequence
  Description of Artificial Sequence: Synthetic peptide
KEVAKKMVEYIIVNS

SEQ ID NO: 7457 - protein, 15 aa, Artificial Sequence
  Description of Artificial Sequence: Synthetic peptide
AAQKTLAEEVTKLVH

SEQ ID NO: 7458 - protein, 15 aa, Artificial Sequence
  Description of Artificial Sequence: Synthetic peptide
LDELNKALRLEALTR

SEQ ID NO: 7459 - protein, 15 aa, Artificial Sequence
  Description of Artificial Sequence: Synthetic peptide
VEQDLKHVVTIKREL

SEQ ID NO: 7460 - protein, 15 aa, Artificial Sequence
  Description of Artificial Sequence: Synthetic peptide
ENTEKLLKILRDNVS

SEQ ID NO: 7461 - protein, 15 aa, Artificial Sequence
  Description of Artificial Sequence: Synthetic peptide
KLVTKIIAHELAHQW

SEQ ID NO: 7462 - protein, 15 aa, Artificial Sequence
  Description of Artificial Sequence: Synthetic peptide
GEDARAALTTLSERV

SEQ ID NO: 7463 - protein, 15 aa, Artificial Sequence
  Description of Artificial Sequence: Synthetic peptide
ATYEIDRVLSQLLKE

SEQ ID NO: 7464 - protein, 15 aa, Artificial Sequence
  Description of Artificial Sequence: Synthetic peptide
NEYLNLVGRLRKIID

SEQ ID NO: 7465 - protein, 15 aa, Artificial Sequence
  Description of Artificial Sequence: Synthetic peptide
PRELKTDLTAFVEQV

SEQ ID NO: 7466 - protein, 15 aa, Artificial Sequence
  Description of Artificial Sequence: Synthetic peptide
AESVTAVKEAEKAIR

SEQ ID NO: 7467 - protein, 15 aa, Artificial Sequence
  Description of Artificial Sequence: Synthetic peptide
SIQRRIKKVTHDMDM

SEQ ID NO: 7468 - protein, 15 aa, Artificial Sequence
  Description of Artificial Sequence: Synthetic peptide
AAITHTARMADKLRL

SEQ ID NO: 7469 - protein, 15 aa, Artificial Sequence
  Description of Artificial Sequence: Synthetic peptide
TKHLHNDVEKERKEK

SEQ ID NO: 7470 - protein, 15 aa, Artificial Sequence
  Description of Artificial Sequence: Synthetic peptide
ALSKSMAEIIRADMR

SEQ ID NO: 7471 - protein, 15 aa, Artificial Sequence
  Description of Artificial Sequence: Synthetic peptide
ALEFLLKAHQTAVDK

SEQ ID NO: 7472 - protein, 15 aa, Artificial Sequence
  Description of Artificial Sequence: Synthetic peptide
ADAVFAEVHRANLSK

SEQ ID NO: 7473 - protein, 15 aa, Artificial Sequence
  Description of Artificial Sequence: Synthetic peptide
ERELEQLSRGWVRGL

SEQ ID NO: 7474 - protein, 15 aa, Artificial Sequence
  Description of Artificial Sequence: Synthetic peptide
TGDRLNFGLAAEKAR

SEQ ID NO: 7475 - protein, 15 aa, Artificial Sequence
  Description of Artificial Sequence: Synthetic peptide
PDFLKKSVDESLKRL

SEQ ID NO: 7476 - protein, 15 aa, Artificial Sequence
  Description of Artificial Sequence: Synthetic peptide
HWNRLNSDASNLKSK

SEQ ID NO: 7477 - protein, 15 aa, Artificial Sequence
  Description of Artificial Sequence: Synthetic peptide
DIQMVESIKRYLERK

SEQ ID NO: 7478 - protein, 15 aa, Artificial Sequence
  Description of Artificial Sequence: Synthetic peptide
DEARINQLFLTALDK

SEQ ID NO: 7479 - protein, 15 aa, Artificial Sequence
  Description of Artificial Sequence: Synthetic peptide
AATLEEKLNKIFEKL

SEQ ID NO: 7480 - protein, 15 aa, Artificial Sequence
  Description of Artificial Sequence: Synthetic peptide
AADVEVSLRASLHRL

SEQ ID NO: 7481 - protein, 15 aa, Artificial Sequence
  Description of Artificial Sequence: Synthetic peptide
RKLLKEAFQKTLTDL

SEQ ID NO: 7482 - protein, 15 aa, Artificial Sequence
  Description of Artificial Sequence: Synthetic peptide
MVQALNRALDEEMAK

SEQ ID NO: 7483 - protein, 15 aa, Artificial Sequence
  Description of Artificial Sequence: Synthetic peptide
QFEKLMENMRNDIAS

SEQ ID NO: 7484 - protein, 15 aa, Artificial Sequence
  Description of Artificial Sequence: Synthetic peptide
ESQAERVRAELARFL

SEQ ID NO: 7485 - protein, 15 aa, Artificial Sequence
  Description of Artificial Sequence: Synthetic peptide
GLVNKAIQDMISKHH

SEQ ID NO: 7486 - protein, 15 aa, Artificial Sequence
  Description of Artificial Sequence: Synthetic peptide
RAQELMIVLEEYIRT

SEQ ID NO: 7487 - protein, 15 aa, Artificial Sequence
  Description of Artificial Sequence: Synthetic peptide
THSLARFAVDQHNTK

SEQ ID NO: 7488 - protein, 15 aa, Artificial Sequence
  Description of Artificial Sequence: Synthetic peptide
RTSKVRQLLDTTDIQ

SEQ ID NO: 7489 - protein, 15 aa, Artificial Sequence
  Description of Artificial Sequence: Synthetic peptide
DLLKHTTNVVKAHTN

SEQ ID NO: 7490 - protein, 15 aa, Artificial Sequence
  Description of Artificial Sequence: Synthetic peptide
EDEARAIVAARLNTL

SEQ ID NO: 7491 - protein, 15 aa, Artificial Sequence
  Description of Artificial Sequence: Synthetic peptide
VYKSAEAVDLATKEL

SEQ ID NO: 7492 - protein, 15 aa, Artificial Sequence
  Description of Artificial Sequence: Synthetic peptide
PLKTLETLRKEVGAY

SEQ ID NO: 7493 - protein, 15 aa, Artificial Sequence
  Description of Artificial Sequence: Synthetic peptide
HEYHAETIKNVRTAT

SEQ ID NO: 7494 - protein, 15 aa, Artificial Sequence
  Description of Artificial Sequence: Synthetic peptide
GMRTYLDLLQHVLDH

SEQ ID NO: 7495 - protein, 15 aa, Artificial Sequence
  Description of Artificial Sequence: Synthetic peptide
ETMRERTLFDRARGL

SEQ ID NO: 7496 - protein, 15 aa, Artificial Sequence
  Description of Artificial Sequence: Synthetic peptide
EKAQQEYRKTLEKII

SEQ ID NO: 7497 - protein, 15 aa, Artificial Sequence
  Description of Artificial Sequence: Synthetic peptide
NSIKDKFEQALIDRV

SEQ ID NO: 7498 - protein, 15 aa, Artificial Sequence
  Description of Artificial Sequence: Synthetic peptide
EKLKIKAQSYLDAIQ

SEQ ID NO: 7499 - protein, 15 aa, Artificial Sequence
  Description of Artificial Sequence: Synthetic peptide
VERLKQVLLHQQAKF

SEQ ID NO: 7500 - protein, 15 aa, Artificial Sequence
  Description of Artificial Sequence: Synthetic peptide
RARYVTLAARLEQET

SEQ ID NO: 7501 - protein, 15 aa, Artificial Sequence
  Description of Artificial Sequence: Synthetic peptide
QMEKLKGALDLLEQF

SEQ ID NO: 7502 - protein, 15 aa, Artificial Sequence
  Description of Artificial Sequence: Synthetic peptide
RNEARMLVDNRLRQL

SEQ ID NO: 7503 - protein, 15 aa, Artificial Sequence
  Description of Artificial Sequence: Synthetic peptide
IENKAADYLKVSAKN

SEQ ID NO: 7504 - protein, 15 aa, Artificial Sequence
  Description of Artificial Sequence: Synthetic peptide
LKEIIDELGKQAKEQ

SEQ ID NO: 7505 - protein, 15 aa, Artificial Sequence
  Description of Artificial Sequence: Synthetic peptide
DADILSWANRKVRTM

SEQ ID NO: 7506 - protein, 15 aa, Artificial Sequence
  Description of Artificial Sequence: Synthetic peptide
ERTLDLAMQRLKAFV

SEQ ID NO: 7507 - protein, 15 aa, Artificial Sequence
  Description of Artificial Sequence: Synthetic peptide
GAESVLQVFREAKAE

SEQ ID NO: 7508 - protein, 15 aa, Artificial Sequence
  Description of Artificial Sequence: Synthetic peptide
RELATQIYHETLKIT

SEQ ID NO: 7509 - protein, 15 aa, Artificial Sequence
  Description of Artificial Sequence: Synthetic peptide
FTRLGQLAEDIQKEI

SEQ ID NO: 7510 - protein, 15 aa, Artificial Sequence
  Description of Artificial Sequence: Synthetic peptide
SDDVKKAIIEGTKAY

SEQ ID NO: 7511 - protein, 15 aa, Artificial Sequence
  Description of Artificial Sequence: Synthetic peptide
EAVDQLVKFNRALAD

SEQ ID NO: 7512 - protein, 15 aa, Artificial Sequence
  Description of Artificial Sequence: Synthetic peptide
EYVRKSVGNALRDIS

SEQ ID NO: 7513 - protein, 15 aa, Artificial Sequence
  Description of Artificial Sequence: Synthetic peptide
ADTLERVTKIIVDRL

SEQ ID NO: 7514 - protein, 15 aa, Artificial Sequence
  Description of Artificial Sequence: Synthetic peptide
ASQYIGDLIHKDIKE

SEQ ID NO: 7515 - protein, 15 aa, Artificial Sequence
  Description of Artificial Sequence: Synthetic peptide
YRQRLTDLGAIAKAE

SEQ ID NO: 7516 - protein, 15 aa, Artificial Sequence
  Description of Artificial Sequence: Synthetic peptide
SDDVKRAIEKGTNDY

SEQ ID NO: 7517 - protein, 15 aa, Artificial Sequence
  Description of Artificial Sequence: Synthetic peptide
LSQLESVMKELYRES

SEQ ID NO: 7518 - protein, 15 aa, Artificial Sequence
  Description of Artificial Sequence: Synthetic peptide
THEIQRMIGRAMRTA

SEQ ID NO: 7519 - protein, 15 aa, Artificial Sequence
  Description of Artificial Sequence: Synthetic peptide
NKDALDLIQEAIKKA

SEQ ID NO: 7520 - protein, 15 aa, Artificial Sequence
  Description of Artificial Sequence: Synthetic peptide
MDSVFAEAIAKVRKQ

SEQ ID NO: 7521 - protein, 16 aa, Artificial Sequence
  Description of Artificial Sequence: Synthetic peptide
QYGEGLARAVQDGLKK

SEQ ID NO: 7522 - protein, 16 aa, Artificial Sequence
  Description of Artificial Sequence: Synthetic peptide
SADRASLIDDAFALAR

SEQ ID NO: 7523 - protein, 16 aa, Artificial Sequence
  Description of Artificial Sequence: Synthetic peptide
PDSKTKLALDIIKGLE

SEQ ID NO: 7524 - protein, 16 aa, Artificial Sequence
  Description of Artificial Sequence: Synthetic peptide
PKTVAEMIDAFSRARD

SEQ ID NO: 7525 - protein, 16 aa, Artificial Sequence
  Description of Artificial Sequence: Synthetic peptide
SVNLLKSHLEELAKKQ

SEQ ID NO: 7526 - protein, 16 aa, Artificial Sequence
  Description of Artificial Sequence: Synthetic peptide
RKAVAHINSVWKDLLE

SEQ ID NO: 7527 - protein, 16 aa, Artificial Sequence
  Description of Artificial Sequence: Synthetic peptide
PETYGRLSVLLKRAAE

SEQ ID NO: 7528 - protein, 16 aa, Artificial Sequence
  Description of Artificial Sequence: Synthetic peptide
REAIAASIHDVVKEVQ

SEQ ID NO: 7529 - protein, 16 aa, Artificial Sequence
  Description of Artificial Sequence: Synthetic peptide
LADAQYLHELLTRKNI

SEQ ID NO: 7530 - protein, 16 aa, Artificial Sequence
  Description of Artificial Sequence: Synthetic peptide
KQALIDSVYARETNRI

SEQ ID NO: 7531 - protein, 16 aa, Artificial Sequence
  Description of Artificial Sequence: Synthetic peptide
PYTLDVIRKDLKKQLL

SEQ ID NO: 7532 - protein, 16 aa, Artificial Sequence
  Description of Artificial Sequence: Synthetic peptide
EKERLFNNLAHLGNIL

SEQ ID NO: 7533 - protein, 16 aa, Artificial Sequence
  Description of Artificial Sequence: Synthetic peptide
EGAQQRMAQEVLTHLK

SEQ ID NO: 7534 - protein, 16 aa, Artificial Sequence
  Description of Artificial Sequence: Synthetic peptide
KQELDAALKKAKELAS

SEQ ID NO: 7535 - protein, 16 aa, Artificial Sequence
  Description of Artificial Sequence: Synthetic peptide
REAIEGWKKITDGVHS

SEQ ID NO: 7536 - protein, 16 aa, Artificial Sequence
  Description of Artificial Sequence: Synthetic peptide
SVLDEAVRVRLSRNVD

SEQ ID NO: 7537 - protein, 16 aa, Artificial Sequence
  Description of Artificial Sequence: Synthetic peptide
PKEMKEFLDEHQKMTS

SEQ ID NO: 7538 - protein, 16 aa, Artificial Sequence
  Description of Artificial Sequence: Synthetic peptide
DEQVRGWNNVTKAVHA

SEQ ID NO: 7539 - protein, 16 aa, Artificial Sequence
  Description of Artificial Sequence: Synthetic peptide
KQEMVDIIETVYRGAR

SEQ ID NO: 7540 - protein, 16 aa, Artificial Sequence
  Description of Artificial Sequence: Synthetic peptide
AERLRDKILASEASFA

SEQ ID NO: 7541 - protein, 16 aa, Artificial Sequence
  Description of Artificial Sequence: Synthetic peptide
AQAKADVLDQIKLALD

SEQ ID NO: 7542 - protein, 16 aa, Artificial Sequence
  Description of Artificial Sequence: Synthetic peptide
PADIVKNLKDNMTILE

SEQ ID NO: 7543 - protein, 16 aa, Artificial Sequence
  Description of Artificial Sequence: Synthetic peptide
LQELDIKIRKILSDKY

SEQ ID NO: 7544 - protein, 16 aa, Artificial Sequence
  Description of Artificial Sequence: Synthetic peptide
PSLVKKINNIREARYE

SEQ ID NO: 7545 - protein, 16 aa, Artificial Sequence
  Description of Artificial Sequence: Synthetic peptide
GELAKHAVSEGTRAVT

SEQ ID NO: 7546 - protein, 16 aa, Artificial Sequence
  Description of Artificial Sequence: Synthetic peptide
EDLKQLKSALYTLLET

SEQ ID NO: 7547 - protein, 16 aa, Artificial Sequence
  Description of Artificial Sequence: Synthetic peptide
ESEKVNEIVKAVKTAL

SEQ ID NO: 7548 - protein, 16 aa, Artificial Sequence
  Description of Artificial Sequence: Synthetic peptide
VEEAVRIVKEVTEKLS

SEQ ID NO: 7549 - protein, 16 aa, Artificial Sequence
  Description of Artificial Sequence: Synthetic peptide
AAENKLNDSLIQELKK

SEQ ID NO: 7550 - protein, 16 aa, Artificial Sequence
  Description of Artificial Sequence: Synthetic peptide
AGTLDWIKESSALAKK

SEQ ID NO: 7551 - protein, 16 aa, Artificial Sequence
  Description of Artificial Sequence: Synthetic peptide
YKDLEGKVKSVLESNR

SEQ ID NO: 7552 - protein, 16 aa, Artificial Sequence
  Description of Artificial Sequence: Synthetic peptide
SDVKQELIKYGKKLVE

SEQ ID NO: 7553 - protein, 16 aa, Artificial Sequence
  Description of Artificial Sequence: Synthetic peptide
ENLVREQIVRVLLERV

SEQ ID NO: 7554 - protein, 16 aa, Artificial Sequence
  Description of Artificial Sequence: Synthetic peptide
KTSHEELAKKLTQVEK

SEQ ID NO: 7555 - protein, 16 aa, Artificial Sequence
  Description of Artificial Sequence: Synthetic peptide
HKEVTTIVEAIKALAN

SEQ ID NO: 7556 - protein, 16 aa, Artificial Sequence
  Description of Artificial Sequence: Synthetic peptide
NQAKELERLIDKAMKK

SEQ ID NO: 7557 - protein, 16 aa, Artificial Sequence
  Description of Artificial Sequence: Synthetic peptide
KLTEKAIGDVFSLLEK

SEQ ID NO: 7558 - protein, 16 aa, Artificial Sequence
  Description of Artificial Sequence: Synthetic peptide
KESVEAMIIAGKSANE

SEQ ID NO: 7559 - protein, 16 aa, Artificial Sequence
  Description of Artificial Sequence: Synthetic peptide
AKELIEKSVALSKAVK

SEQ ID NO: 7560 - protein, 16 aa, Artificial Sequence
  Description of Artificial Sequence: Synthetic peptide
AKIKTIGIEARKDMQE

SEQ ID NO: 7561 - protein, 16 aa, Artificial Sequence
  Description of Artificial Sequence: Synthetic peptide
NEVIDKMRAVQEQVAS

SEQ ID NO: 7562 - protein, 16 aa, Artificial Sequence
  Description of Artificial Sequence: Synthetic peptide
TEKSKELAEIVVQAFL

SEQ ID NO: 7563 - protein, 16 aa, Artificial Sequence
  Description of Artificial Sequence: Synthetic peptide
GPVKEKILSVIKEWGT

SEQ ID NO: 7564 - protein, 16 aa, Artificial Sequence
  Description of Artificial Sequence: Synthetic peptide
VAKDSEAIIKNVIDKY

SEQ ID NO: 7565 - protein, 16 aa, Artificial Sequence
  Description of Artificial Sequence: Synthetic peptide
EVYQILEKGAAKRTTA

SEQ ID NO: 7566 - protein, 16 aa, Artificial Sequence
  Description of Artificial Sequence: Synthetic peptide
QEHRVMLVNSMNTVKE

SEQ ID NO: 7567 - protein, 16 aa, Artificial Sequence
  Description of Artificial Sequence: Synthetic peptide
GESERAVRQVFQRAKN

SEQ ID NO: 7568 - protein, 16 aa, Artificial Sequence
  Description of Artificial Sequence: Synthetic peptide
QNTLDHTSERIARIRV

SEQ ID NO: 7569 - protein, 16 aa, Artificial Sequence
  Description of Artificial Sequence: Synthetic peptide
PLGSKIASAREVIKRD

SEQ ID NO: 7570 - protein, 16 aa, Artificial Sequence
  Description of Artificial Sequence: Synthetic peptide
KVEIQVLEDIYNSLNK

SEQ ID NO: 7571 - protein, 16 aa, Artificial Sequence
  Description of Artificial Sequence: Synthetic peptide
QKRESIVQAAIAEFGD

SEQ ID NO: 7572 - protein, 16 aa, Artificial Sequence
  Description of Artificial Sequence: Synthetic peptide
LDVAAEKIDRFMQAVT

SEQ ID NO: 7573 - protein, 16 aa, Artificial Sequence
  Description of Artificial Sequence: Synthetic peptide
TGDRLNFGLAAEKARR

SEQ ID NO: 7574 - protein, 16 aa, Artificial Sequence
  Description of Artificial Sequence: Synthetic peptide
KPKNLDASITSIIHEI

SEQ ID NO: 7575 - protein, 16 aa, Artificial Sequence
  Description of Artificial Sequence: Synthetic peptide
EDFKVDAQRDIMQRTG

SEQ ID NO: 7576 - protein, 16 aa, Artificial Sequence
  Description of Artificial Sequence: Synthetic peptide
VDVAESLAIERAKSLF

SEQ ID NO: 7577 - protein, 16 aa, Artificial Sequence
  Description of Artificial Sequence: Synthetic peptide
HETALRVTAERAMNTR

SEQ ID NO: 7578 - protein, 16 aa, Artificial Sequence
  Description of Artificial Sequence: Synthetic peptide
QTTKEVLEAKVKGLIR

SEQ ID NO: 7579 - protein, 16 aa, Artificial Sequence
  Description of Artificial Sequence: Synthetic peptide
LDEILKAFKEAHSTVL

SEQ ID NO: 7580 - protein, 16 aa, Artificial Sequence
  Description of Artificial Sequence: Synthetic peptide
SSALDQAAQLRTRLEK

SEQ ID NO: 7581 - protein, 16 aa, Artificial Sequence
  Description of Artificial Sequence: Synthetic peptide
PKTALKIVDTIRKDIL

SEQ ID NO: 7582 - protein, 16 aa, Artificial Sequence
  Description of Artificial Sequence: Synthetic peptide
VRTWLKDAKQVLPEAL

SEQ ID NO: 7583 - protein, 16 aa, Artificial Sequence
  Description of Artificial Sequence: Synthetic peptide
IDEVRNALIRGFSETL

SEQ ID NO: 7584 - protein, 16 aa, Artificial Sequence
  Description of Artificial Sequence: Synthetic peptide
LSERVRESLKVWKNAE

SEQ ID NO: 7585 - protein, 16 aa, Artificial Sequence
  Description of Artificial Sequence: Synthetic peptide
RDDLNLVLATAAKLKA

SEQ ID NO: 7586 - protein, 16 aa, Artificial Sequence
  Description of Artificial Sequence: Synthetic peptide
KNVRDLAIKLRDAKQD

SEQ ID NO: 7587 - protein, 16 aa, Artificial Sequence
  Description of Artificial Sequence: Synthetic peptide
LHEVRNAVENANRVLS

SEQ ID NO: 7588 - protein, 16 aa, Artificial Sequence
  Description of Artificial Sequence: Synthetic peptide
KTIQEVIEALKPLFEK

SEQ ID NO: 7589 - protein, 16 aa, Artificial Sequence
  Description of Artificial Sequence: Synthetic peptide
ESQYKEMEAKVSSTLS

SEQ ID NO: 7590 - protein, 16 aa, Artificial Sequence
  Description of Artificial Sequence: Synthetic peptide
ADRLKAWTEALIRDVN

SEQ ID NO: 7591 - protein, 16 aa, Artificial Sequence
  Description of Artificial Sequence: Synthetic peptide
KEEALELINGYIQKIK

SEQ ID NO: 7592 - protein, 16 aa, Artificial Sequence
  Description of Artificial Sequence: Synthetic peptide
KFENMGAQMVREVASR

SEQ ID NO: 7593 - protein, 16 aa, Artificial Sequence
  Description of Artificial Sequence: Synthetic peptide
SMSVEAAKNARELLLK

SEQ ID NO: 7594 - protein, 16 aa, Artificial Sequence
  Description of Artificial Sequence: Synthetic peptide
RAEAEAEVQRSVERFK

SEQ ID NO: 7595 - protein, 16 aa, Artificial Sequence
  Description of Artificial Sequence: Synthetic peptide
ADDTLALARARGEAMS

SEQ ID NO: 7596 - protein, 16 aa, Artificial Sequence
  Description of Artificial Sequence: Synthetic peptide
PDELARRAAQVIADRT

SEQ ID NO: 7597 - protein, 16 aa, Artificial Sequence
  Description of Artificial Sequence: Synthetic peptide
GRAVNHIKSVWKDLLE

SEQ ID NO: 7598 - protein, 16 aa, Artificial Sequence
  Description of Artificial Sequence: Synthetic peptide
ITKLRTDLRFIAELTI

SEQ ID NO: 7599 - protein, 16 aa, Artificial Sequence
  Description of Artificial Sequence: Synthetic peptide
EVRNIVDKTASFVARN

SEQ ID NO: 7600 - protein, 16 aa, Artificial Sequence
  Description of Artificial Sequence: Synthetic peptide
VELIHKAFIKGIKNAT

SEQ ID NO: 7601 - protein, 16 aa, Artificial Sequence
  Description of Artificial Sequence: Synthetic peptide
REKALELAMAQIDKNF

SEQ ID NO: 7602 - protein, 16 aa, Artificial Sequence
  Description of Artificial Sequence: Synthetic peptide
LVDQEMNNVYERVMKL

SEQ ID NO: 7603 - protein, 16 aa, Artificial Sequence
  Description of Artificial Sequence: Synthetic peptide
NSIKDKFEQALIDRVK

SEQ ID NO: 7604 - protein, 16 aa, Artificial Sequence
  Description of Artificial Sequence: Synthetic peptide
RQHQEKVIGYINSAEQ

SEQ ID NO: 7605 - protein, 16 aa, Artificial Sequence
  Description of Artificial Sequence: Synthetic peptide
EKNLAYARKVKAALET

SEQ ID NO: 7606 - protein, 16 aa, Artificial Sequence
  Description of Artificial Sequence: Synthetic peptide
KELYEHVKQLIALRKQ

SEQ ID NO: 7607 - protein, 16 aa, Artificial Sequence
  Description of Artificial Sequence: Synthetic peptide
RHQMTDLLSMDALYRQ

SEQ ID NO: 7608 - protein, 16 aa, Artificial Sequence
  Description of Artificial Sequence: Synthetic peptide
VVDMEQIMTEKLARQV

SEQ ID NO: 7609 - protein, 16 aa, Artificial Sequence
  Description of Artificial Sequence: Synthetic peptide
AFIRASRALTDKVTDL

SEQ ID NO: 7610 - protein, 16 aa, Artificial Sequence
  Description of Artificial Sequence: Synthetic peptide
MRKVKSVVLFHHSELL

SEQ ID NO: 7611 - protein, 16 aa, Artificial Sequence
  Description of Artificial Sequence: Synthetic peptide
PKAVEITSYIRKVLEE

SEQ ID NO: 7612 - protein, 16 aa, Artificial Sequence
  Description of Artificial Sequence: Synthetic peptide
LAENADKLGIILRNEL

SEQ ID NO: 7613 - protein, 16 aa, Artificial Sequence
  Description of Artificial Sequence: Synthetic peptide
GEAVLDHALTLKKGEN

SEQ ID NO: 7614 - protein, 16 aa, Artificial Sequence
  Description of Artificial Sequence: Synthetic peptide
LGDVLEREASAQQRLG

SEQ ID NO: 7615 - protein, 16 aa, Artificial Sequence
  Description of Artificial Sequence: Synthetic peptide
VESMNKELKKIIGQVR

SEQ ID NO: 7616 - protein, 16 aa, Artificial Sequence
  Description of Artificial Sequence: Synthetic peptide
AEERKATILASLARYL

SEQ ID NO: 7617 - protein, 16 aa, Artificial Sequence
  Description of Artificial Sequence: Synthetic peptide
TDLMNFLKTVRSTTEK

SEQ ID NO: 7618 - protein, 16 aa, Artificial Sequence
  Description of Artificial Sequence: Synthetic peptide
TRDSGLVIKTLVDLFR

SEQ ID NO: 7619 - protein, 16 aa, Artificial Sequence
  Description of Artificial Sequence: Synthetic peptide
LEDLVRLVEAKISRTL

SEQ ID NO: 7620 - protein, 16 aa, Artificial Sequence
  Description of Artificial Sequence: Synthetic peptide
QVHVIREVASMAKEKL

SEQ ID NO: 7621 - protein, 16 aa, Artificial Sequence
  Description of Artificial Sequence: Synthetic peptide
KTNLMAELEKMNKIIQ

SEQ ID NO: 7622 - protein, 16 aa, Artificial Sequence
  Description of Artificial Sequence: Synthetic peptide
LNKAVRETAHETISAI

SEQ ID NO: 7623 - protein, 16 aa, Artificial Sequence
  Description of Artificial Sequence: Synthetic peptide
TNHSIVREYIVQSLRD

SEQ ID NO: 7624 - protein, 16 aa, Artificial Sequence
  Description of Artificial Sequence: Synthetic peptide
RERFLNARDTLRALLD

SEQ ID NO: 7625 - protein, 16 aa, Artificial Sequence
  Description of Artificial Sequence: Synthetic peptide
RTLETSVKDALARANA

SEQ ID NO: 7626 - protein, 16 aa, Artificial Sequence
  Description of Artificial Sequence: Synthetic peptide
DQQARLKLEEIAADIK

SEQ ID NO: 7627 - protein, 16 aa, Artificial Sequence
  Description of Artificial Sequence: Synthetic peptide
EPWAQRVEAAVQRVLD

SEQ ID NO: 7628 - protein, 16 aa, Artificial Sequence
  Description of Artificial Sequence: Synthetic peptide
DEKQKVAVEVIKNLLT

SEQ ID NO: 7629 - protein, 16 aa, Artificial Sequence
  Description of Artificial Sequence: Synthetic peptide
VGELNTRLTDDVSKIN

SEQ ID NO: 7630 - protein, 16 aa, Artificial Sequence
  Description of Artificial Sequence: Synthetic peptide
DTEKRDFVRTVLILKE

SEQ ID NO: 7631 - protein, 16 aa, Artificial Sequence
  Description of Artificial Sequence: Synthetic peptide
ERNLDLKSTIKTIITS

SEQ ID NO: 7632 - protein, 16 aa, Artificial Sequence
  Description of Artificial Sequence: Synthetic peptide
MAKLNQELEGKVADSL

SEQ ID NO: 7633 - protein, 16 aa, Artificial Sequence
  Description of Artificial Sequence: Synthetic peptide
DVVKNDARATASAYLE

SEQ ID NO: 7634 - protein, 16 aa, Artificial Sequence
  Description of Artificial Sequence: Synthetic peptide
AADLKAVQDKLKTFVE

SEQ ID NO: 7635 - protein, 16 aa, Artificial Sequence
  Description of Artificial Sequence: Synthetic peptide
ITLEQAKKLEKRLNEV

SEQ ID NO: 7636 - protein, 16 aa, Artificial Sequence
  Description of Artificial Sequence: Synthetic peptide
LSEIIVDFHDKIKSIS

SEQ ID NO: 7637 - protein, 16 aa, Artificial Sequence
  Description of Artificial Sequence: Synthetic peptide
HKLDAQLTQVLERAQN

SEQ ID NO: 7638 - protein, 16 aa, Artificial Sequence
  Description of Artificial Sequence: Synthetic peptide
SAANKDAIRKQMDAAA

SEQ ID NO: 7639 - protein, 16 aa, Artificial Sequence
  Description of Artificial Sequence: Synthetic peptide
KESAIKVLEKAIKAYQ

SEQ ID NO: 7640 - protein, 16 aa, Artificial Sequence
  Description of Artificial Sequence: Synthetic peptide
DKALKTMVEGLRQVAT

SEQ ID NO: 7641 - protein, 16 aa, Artificial Sequence
  Description of Artificial Sequence: Synthetic peptide
REGKTDLLRIVEKWKT

SEQ ID NO: 7642 - protein, 16 aa, Artificial Sequence
  Description of Artificial Sequence: Synthetic peptide
VKETDRIAAMVDGLQK

SEQ ID NO: 7643 - protein, 16 aa, Artificial Sequence
  Description of Artificial Sequence: Synthetic peptide
SRADAAVTDDARGLLA

SEQ ID NO: 7644 - protein, 16 aa, Artificial Sequence
  Description of Artificial Sequence: Synthetic peptide
PYSVRAKDLAEKLSNE

SEQ ID NO: 7645 - protein, 16 aa, Artificial Sequence
  Description of Artificial Sequence: Synthetic peptide
KELVDQYKAAQEAARV

SEQ ID NO: 7646 - protein, 16 aa, Artificial Sequence
  Description of Artificial Sequence: Synthetic peptide
ESDWKIARQIGPTLKE

SEQ ID NO: 7647 - protein, 16 aa, Artificial Sequence
  Description of Artificial Sequence: Synthetic peptide
LKLKEINVVNEITKIL

SEQ ID NO: 7648 - protein, 16 aa, Artificial Sequence
  Description of Artificial Sequence: Synthetic peptide
DELRDKVNGALKTLRE

SEQ ID NO: 7649 - protein, 16 aa, Artificial Sequence
  Description of Artificial Sequence: Synthetic peptide
PAFIVEESIKAQRKLL

SEQ ID NO: 7650 - protein, 16 aa, Artificial Sequence
  Description of Artificial Sequence: Synthetic peptide
TELKHTLESEGRELVK

SEQ ID NO: 7651 - protein, 16 aa, Artificial Sequence
  Description of Artificial Sequence: Synthetic peptide
HEYHAETIKNVRTATE

SEQ ID NO: 7652 - protein, 16 aa, Artificial Sequence
  Description of Artificial Sequence: Synthetic peptide
GTEANEAALKFARAHT

SEQ ID NO: 7653 - protein, 16 aa, Artificial Sequence
  Description of Artificial Sequence: Synthetic peptide
ISTLDFEIRHQLTKIH

SEQ ID NO: 7654 - protein, 16 aa, Artificial Sequence
  Description of Artificial Sequence: Synthetic peptide
PKFREAVKAASDELSK

SEQ ID NO: 7655 - protein, 16 aa, Artificial Sequence
  Description of Artificial Sequence: Synthetic peptide
EISKAVDVYNSLKDRL

SEQ ID NO: 7656 - protein, 16 aa, Artificial Sequence
  Description of Artificial Sequence: Synthetic peptide
FRQAHTASGKAVHLAE

SEQ ID NO: 7657 - protein, 16 aa, Artificial Sequence
  Description of Artificial Sequence: Synthetic peptide
ASQREAAERAMRQRDR

SEQ ID NO: 7658 - protein, 16 aa, Artificial Sequence
  Description of Artificial Sequence: Synthetic peptide
PDQIGAKGVETADKVL

SEQ ID NO: 7659 - protein, 16 aa, Artificial Sequence
  Description of Artificial Sequence: Synthetic peptide
SEGLARIDAYLKNEIQ

SEQ ID NO: 7660 - protein, 16 aa, Artificial Sequence
  Description of Artificial Sequence: Synthetic peptide
NTVNVHIHRIREKLEK

SEQ ID NO: 7661 - protein, 16 aa, Artificial Sequence
  Description of Artificial Sequence: Synthetic peptide
GQVGRQLKIIGDDINR

SEQ ID NO: 7662 - protein, 16 aa, Artificial Sequence
  Description of Artificial Sequence: Synthetic peptide
WDVIRDKTKTKIESLK

SEQ ID NO: 7663 - protein, 16 aa, Artificial Sequence
  Description of Artificial Sequence: Synthetic peptide
KSRLIDRASQLLEVIR

SEQ ID NO: 7664 - protein, 16 aa, Artificial Sequence
  Description of Artificial Sequence: Synthetic peptide
PTAKAELVKLIKAMQE

SEQ ID NO: 7665 - protein, 16 aa, Artificial Sequence
  Description of Artificial Sequence: Synthetic peptide
RDANERVAEFIRNKIR

SEQ ID NO: 7666 - protein, 16 aa, Artificial Sequence
  Description of Artificial Sequence: Synthetic peptide
RLHTVMERLMDKISFS

SEQ ID NO: 7667 - protein, 16 aa, Artificial Sequence
  Description of Artificial Sequence: Synthetic peptide
PYSKQHTITLARELAK

SEQ ID NO: 7668 - protein, 16 aa, Artificial Sequence
  Description of Artificial Sequence: Synthetic peptide
KLSLNVVRKLIELLKE

SEQ ID NO: 7669 - protein, 16 aa, Artificial Sequence
  Description of Artificial Sequence: Synthetic peptide
PQDRAALLARVDQLAR

SEQ ID NO: 7670 - protein, 16 aa, Artificial Sequence
  Description of Artificial Sequence: Synthetic peptide
LESALAMLADAQQRKD

SEQ ID NO: 7671 - protein, 16 aa, Artificial Sequence
  Description of Artificial Sequence: Synthetic peptide
NEDLKKLEASAIELAK

SEQ ID NO: 7672 - protein, 16 aa, Artificial Sequence
  Description of Artificial Sequence: Synthetic peptide
IFALAQEINELAEKAR

SEQ ID NO: 7673 - protein, 16 aa, Artificial Sequence
  Description of Artificial Sequence: Synthetic peptide
EQAVLAQRIVDKIWRD

SEQ ID NO: 7674 - protein, 16 aa, Artificial Sequence
  Description of Artificial Sequence: Synthetic peptide
PLGQALRAIGDEFETR

SEQ ID NO: 7675 - protein, 16 aa, Artificial Sequence
  Description of Artificial Sequence: Synthetic peptide
SETVDRAFGQMKAAIR

SEQ ID NO: 7676 - protein, 16 aa, Artificial Sequence
  Description of Artificial Sequence: Synthetic peptide
FRDLALRVDQIRDQMA

SEQ ID NO: 7677 - protein, 16 aa, Artificial Sequence
  Description of Artificial Sequence: Synthetic peptide
SAVQIKRELNHLLYQR

SEQ ID NO: 7678 - protein, 16 aa, Artificial Sequence
  Description of Artificial Sequence: Synthetic peptide
AEVKETLALAEAAANK

SEQ ID NO: 7679 - protein, 16 aa, Artificial Sequence
  Description of Artificial Sequence: Synthetic peptide
KKDDEVFRTAVGDLNQ

SEQ ID NO: 7680 - protein, 16 aa, Artificial Sequence
  Description of Artificial Sequence: Synthetic peptide
DAEVNRAKAQLKAALL

SEQ ID NO: 7681 - protein, 16 aa, Artificial Sequence
  Description of Artificial Sequence: Synthetic peptide
KSEREDLIKYLKQATS

SEQ ID NO: 7682 - protein, 16 aa, Artificial Sequence
  Description of Artificial Sequence: Synthetic peptide
PKGQMALKFKELVEQR

SEQ ID NO: 7683 - protein, 16 aa, Artificial Sequence
  Description of Artificial Sequence: Synthetic peptide
PEQALNDAVKIMKEKI

SEQ ID NO: 7684 - protein, 16 aa, Artificial Sequence
  Description of Artificial Sequence: Synthetic peptide
SKNVSDMIDKVHEEMK

SEQ ID NO: 7685 - protein, 16 aa, Artificial Sequence
  Description of Artificial Sequence: Synthetic peptide
ADAVFAEVHRANLSKA

SEQ ID NO: 7686 - protein, 16 aa, Artificial Sequence
  Description of Artificial Sequence: Synthetic peptide
QLSKSMDAVAESIYEK

SEQ ID NO: 7687 - protein, 16 aa, Artificial Sequence
  Description of Artificial Sequence: Synthetic peptide
FDTALNTVIDAIDKIR

SEQ ID NO: 7688 - protein, 16 aa, Artificial Sequence
  Description of Artificial Sequence: Synthetic peptide
EQGVMKAFEAALKDTA

SEQ ID NO: 7689 - protein, 16 aa, Artificial Sequence
  Description of Artificial Sequence: Synthetic peptide
PVEVAERIRTVVAAET

SEQ ID NO: 7690 - protein, 16 aa, Artificial Sequence
  Description of Artificial Sequence: Synthetic peptide
GDAKLAEAKAAARQNL

SEQ ID NO: 7691 - protein, 16 aa, Artificial Sequence
  Description of Artificial Sequence: Synthetic peptide
SGKFVNGILDRIAKEH

SEQ ID NO: 7692 - protein, 16 aa, Artificial Sequence
  Description of Artificial Sequence: Synthetic peptide
QRAFVKNVDAIERAKG

SEQ ID NO: 7693 - protein, 16 aa, Artificial Sequence
  Description of Artificial Sequence: Synthetic peptide
SRVEQVLADLKNFSKE

SEQ ID NO: 7694 - protein, 16 aa, Artificial Sequence
  Description of Artificial Sequence: Synthetic peptide
KTQIYAVKDKIETLLI

SEQ ID NO: 7695 - protein, 16 aa, Artificial Sequence
  Description of Artificial Sequence: Synthetic peptide
DRQNKAYKEAMEALKE

SEQ ID NO: 7696 - protein, 16 aa, Artificial Sequence
  Description of Artificial Sequence: Synthetic peptide
NEAADLIEKAINMAIR

SEQ ID NO: 7697 - protein, 16 aa, Artificial Sequence
  Description of Artificial Sequence: Synthetic peptide
VAARSDLLVDQWKKKA

SEQ ID NO: 7698 - protein, 16 aa, Artificial Sequence
  Description of Artificial Sequence: Synthetic peptide
VREVFEMATRAALQAR

SEQ ID NO: 7699 - protein, 16 aa, Artificial Sequence
  Description of Artificial Sequence: Synthetic peptide
ENDLQRATDLAYRMVS

SEQ ID NO: 7700 - protein, 16 aa, Artificial Sequence
  Description of Artificial Sequence: Synthetic peptide
HEKLTQARNQLLAEAA

SEQ ID NO: 7701 - protein, 16 aa, Artificial Sequence
  Description of Artificial Sequence: Synthetic peptide
LGHQVASDYLRIMERA

SEQ ID NO: 7702 - protein, 16 aa, Artificial Sequence
  Description of Artificial Sequence: Synthetic peptide
RDKILSDVLAKFSAAI

SEQ ID NO: 7703 - protein, 16 aa, Artificial Sequence
  Description of Artificial Sequence: Synthetic peptide
DIHQIIDSIQETKKLK

SEQ ID NO: 7704 - protein, 16 aa, Artificial Sequence
  Description of Artificial Sequence: Synthetic peptide
RDIINARLREELDKIT

SEQ ID NO: 7705 - protein, 16 aa, Artificial Sequence
  Description of Artificial Sequence: Synthetic peptide
IGKITRTVSDYVQEAR

SEQ ID NO: 7706 - protein, 16 aa, Artificial Sequence
  Description of Artificial Sequence: Synthetic peptide
ENVHARIEGFKSALDV

SEQ ID NO: 7707 - protein, 16 aa, Artificial Sequence
  Description of Artificial Sequence: Synthetic peptide
KQAVSMFLGAVEEAKK

SEQ ID NO: 7708 - protein, 16 aa, Artificial Sequence
  Description of Artificial Sequence: Synthetic peptide
PDEMRKEVLMQLLNVK

SEQ ID NO: 7709 - protein, 16 aa, Artificial Sequence
  Description of Artificial Sequence: Synthetic peptide
HREAVEHFLEALNMQR

SEQ ID NO: 7710 - protein, 16 aa, Artificial Sequence
  Description of Artificial Sequence: Synthetic peptide
RVPEQKLGAAIDEFAS

SEQ ID NO: 7711 - protein, 16 aa, Artificial Sequence
  Description of Artificial Sequence: Synthetic peptide
GDQADRYAVKLLNHLR

SEQ ID NO: 7712 - protein, 16 aa, Artificial Sequence
  Description of Artificial Sequence: Synthetic peptide
ISYVQGERQARNVLRE

SEQ ID NO: 7713 - protein, 16 aa, Artificial Sequence
  Description of Artificial Sequence: Synthetic peptide
DKFLQDKKLLISILEK

SEQ ID NO: 7714 - protein, 16 aa, Artificial Sequence
  Description of Artificial Sequence: Synthetic peptide
AEGQAYRDNVARIIKN

SEQ ID NO: 7715 - protein, 16 aa, Artificial Sequence
  Description of Artificial Sequence: Synthetic peptide
EGDLFTQLRKIVKMAS

SEQ ID NO: 7716 - protein, 16 aa, Artificial Sequence
  Description of Artificial Sequence: Synthetic peptide
LDELVKETKKKIIDTL

SEQ ID NO: 7717 - protein, 16 aa, Artificial Sequence
  Description of Artificial Sequence: Synthetic peptide
PATVVTALEQLAHHHH

SEQ ID NO: 7718 - protein, 16 aa, Artificial Sequence
  Description of Artificial Sequence: Synthetic peptide
AREMANAKEIARTVQI

SEQ ID NO: 7719 - protein, 16 aa, Artificial Sequence
  Description of Artificial Sequence: Synthetic peptide
VELGRQLGAAYQRLDD

SEQ ID NO: 7720 - protein, 16 aa, Artificial Sequence
  Description of Artificial Sequence: Synthetic peptide
RDELKALIQKVTHNLV

SEQ ID NO: 7721 - protein, 16 aa, Artificial Sequence
  Description of Artificial Sequence: Synthetic peptide
RSELSDLGTLIKDNLK

SEQ ID NO: 7722 - protein, 16 aa, Artificial Sequence
  Description of Artificial Sequence: Synthetic peptide
VQDLGSTVIKEVLKRA

SEQ ID NO: 7723 - protein, 16 aa, Artificial Sequence
  Description of Artificial Sequence: Synthetic peptide
IIPRTLHQIFEKLTDN

SEQ ID NO: 7724 - protein, 16 aa, Artificial Sequence
  Description of Artificial Sequence: Synthetic peptide
TNELKEIVRKIGKDLS

SEQ ID NO: 7725 - protein, 16 aa, Artificial Sequence
  Description of Artificial Sequence: Synthetic peptide
PTIRERIEAMTAEASK

SEQ ID NO: 7726 - protein, 16 aa, Artificial Sequence
  Description of Artificial Sequence: Synthetic peptide
QEARLGIKPHIQRLLD

SEQ ID NO: 7727 - protein, 16 aa, Artificial Sequence
  Description of Artificial Sequence: Synthetic peptide
TADRDILARLHKAVTS

SEQ ID NO: 7728 - protein, 16 aa, Artificial Sequence
  Description of Artificial Sequence: Synthetic peptide
DGELNLMKKAASITSE

SEQ ID NO: 7729 - protein, 16 aa, Artificial Sequence
  Description of Artificial Sequence: Synthetic peptide
TDAINRGNERLLRYLQ

SEQ ID NO: 7730 - protein, 16 aa, Artificial Sequence
  Description of Artificial Sequence: Synthetic peptide
REKALELAVAQIEKSY

SEQ ID NO: 7731 - protein, 16 aa, Artificial Sequence
  Description of Artificial Sequence: Synthetic peptide
GDVKVWMQNLEDLHTR

SEQ ID NO: 7732 - protein, 16 aa, Artificial Sequence
  Description of Artificial Sequence: Synthetic peptide
ENFTQRVSTNLEKMKQ

SEQ ID NO: 7733 - protein, 16 aa, Artificial Sequence
  Description of Artificial Sequence: Synthetic peptide
HAAGDRMLQEVATRLS

SEQ ID NO: 7734 - protein, 16 aa, Artificial Sequence
  Description of Artificial Sequence: Synthetic peptide
KTDRIKLEQVISGALK

SEQ ID NO: 7735 - protein, 16 aa, Artificial Sequence
  Description of Artificial Sequence: Synthetic peptide
EKSREFAEKLNREARD

SEQ ID NO: 7736 - protein, 16 aa, Artificial Sequence
  Description of Artificial Sequence: Synthetic peptide
SANTKRVMDIFLKINE

SEQ ID NO: 7737 - protein, 16 aa, Artificial Sequence
  Description of Artificial Sequence: Synthetic peptide
RQELELSVKKELEKIL

SEQ ID NO: 7738 - protein, 16 aa, Artificial Sequence
  Description of Artificial Sequence: Synthetic peptide
SEHLAKMLSKHLERVI

SEQ ID NO: 7739 - protein, 16 aa, Artificial Sequence
  Description of Artificial Sequence: Synthetic peptide
VFETLKEVSRLVLARV

SEQ ID NO: 7740 - protein, 16 aa, Artificial Sequence
  Description of Artificial Sequence: Synthetic peptide
DSVKIEAAKLKKSFLT

SEQ ID NO: 7741 - protein, 16 aa, Artificial Sequence
  Description of Artificial Sequence: Synthetic peptide
PTARERTTGAVDALKA

SEQ ID NO: 7742 - protein, 16 aa, Artificial Sequence
  Description of Artificial Sequence: Synthetic peptide
FKQLVEDLDRILTLTT

SEQ ID NO: 7743 - protein, 16 aa, Artificial Sequence
  Description of Artificial Sequence: Synthetic peptide
TGAMITGTMVDELERR

SEQ ID NO: 7744 - protein, 16 aa, Artificial Sequence
  Description of Artificial Sequence: Synthetic peptide
ETVLESYRTNSLRKIN

SEQ ID NO: 7745 - protein, 16 aa, Artificial Sequence
  Description of Artificial Sequence: Synthetic peptide
DLEKAKTHLVVLWASQ

SEQ ID NO: 7746 - protein, 16 aa, Artificial Sequence
  Description of Artificial Sequence: Synthetic peptide
KRTLNRYEKIANDIDA

SEQ ID NO: 7747 - protein, 16 aa, Artificial Sequence
  Description of Artificial Sequence: Synthetic peptide
DKAAFAAQKQKADALL

SEQ ID NO: 7748 - protein, 16 aa, Artificial Sequence
  Description of Artificial Sequence: Synthetic peptide
QALKDYEAHLASLGRS

SEQ ID NO: 7749 - protein, 16 aa, Artificial Sequence
  Description of Artificial Sequence: Synthetic peptide
PKTVNEMIDAFTKARD

SEQ ID NO: 7750 - protein, 16 aa, Artificial Sequence
  Description of Artificial Sequence: Synthetic peptide
AGLSEKVDRLHSYLNR

SEQ ID NO: 7751 - protein, 16 aa, Artificial Sequence
  Description of Artificial Sequence: Synthetic peptide
HQGVAIDTFAKEVEKR

SEQ ID NO: 7752 - protein, 16 aa, Artificial Sequence
  Description of Artificial Sequence: Synthetic peptide
VEKSVETLLDLIMKRM

SEQ ID NO: 7753 - protein, 16 aa, Artificial Sequence
  Description of Artificial Sequence: Synthetic peptide
PKEIQIQIRKFVGELI

SEQ ID NO: 7754 - protein, 16 aa, Artificial Sequence
  Description of Artificial Sequence: Synthetic peptide
DDVKKLAEETEARIKS

SEQ ID NO: 7755 - protein, 16 aa, Artificial Sequence
  Description of Artificial Sequence: Synthetic peptide
DDLMEAAAKRFKEQVS

SEQ ID NO: 7756 - protein, 16 aa, Artificial Sequence
  Description of Artificial Sequence: Synthetic peptide
MRNHAKTDRVFDLAAR

SEQ ID NO: 7757 - protein, 16 aa, Artificial Sequence
  Description of Artificial Sequence: Synthetic peptide
ARHMRELLTQMGHLYG

SEQ ID NO: 7758 - protein, 16 aa, Artificial Sequence
  Description of Artificial Sequence: Synthetic peptide
PYNSRADELARLAIKE

SEQ ID NO: 7759 - protein, 16 aa, Artificial Sequence
  Description of Artificial Sequence: Synthetic peptide
TDLIKRIGQATAKEVA

SEQ ID NO: 7760 - protein, 16 aa, Artificial Sequence
  Description of Artificial Sequence: Synthetic peptide
PYGRDRDGQVAAALKT

SEQ ID NO: 7761 - protein, 16 aa, Artificial Sequence
  Description of Artificial Sequence: Synthetic peptide
KELVLRILTVRENLAE

SEQ ID NO: 7762 - protein, 16 aa, Artificial Sequence
  Description of Artificial Sequence: Synthetic peptide
KNTADQVAVEAMRERM

SEQ ID NO: 7763 - protein, 16 aa, Artificial Sequence
  Description of Artificial Sequence: Synthetic peptide
AKGQQEAARAGELLKE

SEQ ID NO: 7764 - protein, 16 aa, Artificial Sequence
  Description of Artificial Sequence: Synthetic peptide
DVLYSLSKTLKDARDK

SEQ ID NO: 7765 - protein, 16 aa, Artificial Sequence
  Description of Artificial Sequence: Synthetic peptide
LTELNSLISRLADDTK

SEQ ID NO: 7766 - protein, 16 aa, Artificial Sequence
  Description of Artificial Sequence: Synthetic peptide
GTKVTKMEDDIKKLLG

SEQ ID NO: 7767 - protein, 16 aa, Artificial Sequence
  Description of Artificial Sequence: Synthetic peptide
GLQRAKTGTDKTLVKE

SEQ ID NO: 7768 - protein, 16 aa, Artificial Sequence
  Description of Artificial Sequence: Synthetic peptide
PEKTKAVENYLIQMAR

SEQ ID NO: 7769 - protein, 16 aa, Artificial Sequence
  Description of Artificial Sequence: Synthetic peptide
DEKTAITKGYEALIKR

SEQ ID NO: 7770 - protein, 16 aa, Artificial Sequence
  Description of Artificial Sequence: Synthetic peptide
AEVYDIIKKESNRQRV

SEQ ID NO: 7771 - protein, 16 aa, Artificial Sequence
  Description of Artificial Sequence: Synthetic peptide
AARTVRAQLREWLAEI

SEQ ID NO: 7772 - protein, 16 aa, Artificial Sequence
  Description of Artificial Sequence: Synthetic peptide
VSSIRDADRVIGLLES

SEQ ID NO: 7773 - protein, 16 aa, Artificial Sequence
  Description of Artificial Sequence: Synthetic peptide
SAEAVKKTAEDLAKEL

SEQ ID NO: 7774 - protein, 16 aa, Artificial Sequence
  Description of Artificial Sequence: Synthetic peptide
NAVSLVMRRIRKENVD

SEQ ID NO: 7775 - protein, 16 aa, Artificial Sequence
  Description of Artificial Sequence: Synthetic peptide
LSQHERYVEQLKQALK

SEQ ID NO: 7776 - protein, 16 aa, Artificial Sequence
  Description of Artificial Sequence: Synthetic peptide
EADMKRVVLSLVTMLH

SEQ ID NO: 7777 - protein, 16 aa, Artificial Sequence
  Description of Artificial Sequence: Synthetic peptide
PEAINRGNERLLRYLQ

SEQ ID NO: 7778 - protein, 16 aa, Artificial Sequence
  Description of Artificial Sequence: Synthetic peptide
EKTRDAALILAQKAHA

SEQ ID NO: 7779 - protein, 16 aa, Artificial Sequence
  Description of Artificial Sequence: Synthetic peptide
KNELVQRLIKDDEESK

SEQ ID NO: 7780 - protein, 16 aa, Artificial Sequence
  Description of Artificial Sequence: Synthetic peptide
IFERLTSELLGVMAKK

SEQ ID NO: 7781 - protein, 16 aa, Artificial Sequence
  Description of Artificial Sequence: Synthetic peptide
MEEMRKEIIAVIQKYT

SEQ ID NO: 7782 - protein, 16 aa, Artificial Sequence
  Description of Artificial Sequence: Synthetic peptide
LDDVDFINKRITVLAN

SEQ ID NO: 7783 - protein, 16 aa, Artificial Sequence
  Description of Artificial Sequence: Synthetic peptide
IATRKKWVSLVEGVKE

SEQ ID NO: 7784 - protein, 16 aa, Artificial Sequence
  Description of Artificial Sequence: Synthetic peptide
RAELDALLTQAALFKR

SEQ ID NO: 7785 - protein, 16 aa, Artificial Sequence
  Description of Artificial Sequence: Synthetic peptide
AQELDIKARNFLINKK

SEQ ID NO: 7786 - protein, 16 aa, Artificial Sequence
  Description of Artificial Sequence: Synthetic peptide
EKSILGAKEALSILNR

SEQ ID NO: 7787 - protein, 16 aa, Artificial Sequence
  Description of Artificial Sequence: Synthetic peptide
NELREALNKAFAEMRA

SEQ ID NO: 7788 - protein, 16 aa, Artificial Sequence
  Description of Artificial Sequence: Synthetic peptide
DKGFQKVIADMSGPHV

SEQ ID NO: 7789 - protein, 16 aa, Artificial Sequence
  Description of Artificial Sequence: Synthetic peptide
LSYREAVLRAVDRLNE

SEQ ID NO: 7790 - protein, 16 aa, Artificial Sequence
  Description of Artificial Sequence: Synthetic peptide
HLSGDEVLKTVSKRIL

SEQ ID NO: 7791 - protein, 16 aa, Artificial Sequence
  Description of Artificial Sequence: Synthetic peptide
TELKKITDKTIKAFMD

SEQ ID NO: 7792 - protein, 16 aa, Artificial Sequence
  Description of Artificial Sequence: Synthetic peptide
FRDLALRVDQIRDNMA

SEQ ID NO: 7793 - protein, 16 aa, Artificial Sequence
  Description of Artificial Sequence: Synthetic peptide
VQDIERAVAKLAQKLK

SEQ ID NO: 7794 - protein, 16 aa, Artificial Sequence
  Description of Artificial Sequence: Synthetic peptide
VEIGEKIAQIAIDRAS

SEQ ID NO: 7795 - protein, 16 aa, Artificial Sequence
  Description of Artificial Sequence: Synthetic peptide
AHTYIAAKKIENEAKK

SEQ ID NO: 7796 - protein, 16 aa, Artificial Sequence
  Description of Artificial Sequence: Synthetic peptide
EETLINHAKAWASAIR

SEQ ID NO: 7797 - protein, 16 aa, Artificial Sequence
  Description of Artificial Sequence: Synthetic peptide
RAERREVENVVVTALA

SEQ ID NO: 7798 - protein, 16 aa, Artificial Sequence
  Description of Artificial Sequence: Synthetic peptide
TNLTKLEVLLEISDKL

SEQ ID NO: 7799 - protein, 16 aa, Artificial Sequence
  Description of Artificial Sequence: Synthetic peptide
PEFREKALKAMETERQ

SEQ ID NO: 7800 - protein, 16 aa, Artificial Sequence
  Description of Artificial Sequence: Synthetic peptide
DAINQKAQELARKAVA

SEQ ID NO: 7801 - protein, 16 aa, Artificial Sequence
  Description of Artificial Sequence: Synthetic peptide
PRELLIARQAANVIEH

SEQ ID NO: 7802 - protein, 16 aa, Artificial Sequence
  Description of Artificial Sequence: Synthetic peptide
QEEALELINGYIQKIK

SEQ ID NO: 7803 - protein, 16 aa, Artificial Sequence
  Description of Artificial Sequence: Synthetic peptide
DERNRQIAEIGASLIK

SEQ ID NO: 7804 - protein, 16 aa, Artificial Sequence
  Description of Artificial Sequence: Synthetic peptide
LKEAMDLGTEAAKYVS

SEQ ID NO: 7805 - protein, 16 aa, Artificial Sequence
  Description of Artificial Sequence: Synthetic peptide
AHIQHDKTTSALKILS

SEQ ID NO: 7806 - protein, 16 aa, Artificial Sequence
  Description of Artificial Sequence: Synthetic peptide
ASLKEFLKSLLEAIIK

SEQ ID NO: 7807 - protein, 16 aa, Artificial Sequence
  Description of Artificial Sequence: Synthetic peptide
SETVDRAFSQMKAAIR

SEQ ID NO: 7808 - protein, 16 aa, Artificial Sequence
  Description of Artificial Sequence: Synthetic peptide
RENFEILMKLKESLEL

SEQ ID NO: 7809 - protein, 16 aa, Artificial Sequence
  Description of Artificial Sequence: Synthetic peptide
PQLAHDRITEAARQVR

SEQ ID NO: 7810 - protein, 16 aa, Artificial Sequence
  Description of Artificial Sequence: Synthetic peptide
APYRKEQRLREVLSGL

SEQ ID NO: 7811 - protein, 16 aa, Artificial Sequence
  Description of Artificial Sequence: Synthetic peptide
RQEVQDTARGQINDYI

SEQ ID NO: 7812 - protein, 16 aa, Artificial Sequence
  Description of Artificial Sequence: Synthetic peptide
MTLAKTEAKLLHEKIS

SEQ ID NO: 7813 - protein, 16 aa, Artificial Sequence
  Description of Artificial Sequence: Synthetic peptide
SDLVYETINRVKRIKD

SEQ ID NO: 7814 - protein, 16 aa, Artificial Sequence
  Description of Artificial Sequence: Synthetic peptide
RRKFEEVDTNLKVLLH

SEQ ID NO: 7815 - protein, 16 aa, Artificial Sequence
  Description of Artificial Sequence: Synthetic peptide
LDRLRQFIGELATLLD

SEQ ID NO: 7816 - protein, 16 aa, Artificial Sequence
  Description of Artificial Sequence: Synthetic peptide
VSKMNDMVKLVEKLLA

SEQ ID NO: 7817 - protein, 16 aa, Artificial Sequence
  Description of Artificial Sequence: Synthetic peptide
GGEAKAVETLKQQIQK

SEQ ID NO: 7818 - protein, 16 aa, Artificial Sequence
  Description of Artificial Sequence: Synthetic peptide
KEDVDVAVAAAKTALT

SEQ ID NO: 7819 - protein, 16 aa, Artificial Sequence
  Description of Artificial Sequence: Synthetic peptide
ATDVSKRLDLAVRLLI

SEQ ID NO: 7820 - protein, 16 aa, Artificial Sequence
  Description of Artificial Sequence: Synthetic peptide
REEAISNMVVALKELS

SEQ ID NO: 7821 - protein, 16 aa, Artificial Sequence
  Description of Artificial Sequence: Synthetic peptide
AVIEMTKKVKPHLVAS

SEQ ID NO: 7822 - protein, 16 aa, Artificial Sequence
  Description of Artificial Sequence: Synthetic peptide
AVIEMTQKTKEHLIKT

SEQ ID NO: 7823 - protein, 16 aa, Artificial Sequence
  Description of Artificial Sequence: Synthetic peptide
LSAAEHLLKAQEHLIG

SEQ ID NO: 7824 - protein, 16 aa, Artificial Sequence
  Description of Artificial Sequence: Synthetic peptide
DNDRAFTIKKLAELVK

SEQ ID NO: 7825 - protein, 16 aa, Artificial Sequence
  Description of Artificial Sequence: Synthetic peptide
KEEHTELVKDLIAKLN

SEQ ID NO: 7826 - protein, 16 aa, Artificial Sequence
  Description of Artificial Sequence: Synthetic peptide
TQHWVLEGIERAVKEA

SEQ ID NO: 7827 - protein, 16 aa, Artificial Sequence
  Description of Artificial Sequence: Synthetic peptide
GDSQDTAYKVSQLADR

SEQ ID NO: 7828 - protein, 16 aa, Artificial Sequence
  Description of Artificial Sequence: Synthetic peptide
GARLAEYHAKATEHLS

SEQ ID NO: 7829 - protein, 16 aa, Artificial Sequence
  Description of Artificial Sequence: Synthetic peptide
YKKRLNELITDALITS

SEQ ID NO: 7830 - protein, 16 aa, Artificial Sequence
  Description of Artificial Sequence: Synthetic peptide
RQEALELIKKGYTQQL

SEQ ID NO: 7831 - protein, 16 aa, Artificial Sequence
  Description of Artificial Sequence: Synthetic peptide
SVRMRAIQNRLLHELG

SEQ ID NO: 7832 - protein, 16 aa, Artificial Sequence
  Description of Artificial Sequence: Synthetic peptide
SEPLLHLREKIARLVT

SEQ ID NO: 7833 - protein, 16 aa, Artificial Sequence
  Description of Artificial Sequence: Synthetic peptide
RGHQKLINATVEKARE

SEQ ID NO: 7834 - protein, 16 aa, Artificial Sequence
  Description of Artificial Sequence: Synthetic peptide
LESSHALAHALKMMRE

SEQ ID NO: 7835 - protein, 16 aa, Artificial Sequence
  Description of Artificial Sequence: Synthetic peptide
KQTESHAVKIVVEAAR

SEQ ID NO: 7836 - protein, 16 aa, Artificial Sequence
  Description of Artificial Sequence: Synthetic peptide
PEDMLEQFKTVRALIR

SEQ ID NO: 7837 - protein, 16 aa, Artificial Sequence
  Description of Artificial Sequence: Synthetic peptide
EDDVKSLSRVMIHVFS

SEQ ID NO: 7838 - protein, 16 aa, Artificial Sequence
  Description of Artificial Sequence: Synthetic peptide
AYADVIVNSALEKLRK

SEQ ID NO: 7839 - protein, 16 aa, Artificial Sequence
  Description of Artificial Sequence: Synthetic peptide
IYEHLQKLVQAELKLI

SEQ ID NO: 7840 - protein, 16 aa, Artificial Sequence
  Description of Artificial Sequence: Synthetic peptide
KDAFLLIQRLTRIILH

SEQ ID NO: 7841 - protein, 16 aa, Artificial Sequence
  Description of Artificial Sequence: Synthetic peptide
EQGNREARQAGQLLKE

SEQ ID NO: 7842 - protein, 16 aa, Artificial Sequence
  Description of Artificial Sequence: Synthetic peptide
QATLDKLEAGFKKLQE

SEQ ID NO: 7843 - protein, 16 aa, Artificial Sequence
  Description of Artificial Sequence: Synthetic peptide
AVIYLISHKLVKKSLD

SEQ ID NO: 7844 - protein, 16 aa, Artificial Sequence
  Description of Artificial Sequence: Synthetic peptide
RVHKINNVNKALDFIA

SEQ ID NO: 7845 - protein, 16 aa, Artificial Sequence
  Description of Artificial Sequence: Synthetic peptide
FDTALTDLKTIIRAER

SEQ ID NO: 7846 - protein, 16 aa, Artificial Sequence
  Description of Artificial Sequence: Synthetic peptide
DGTQRGALVISQEAKR

SEQ ID NO: 7847 - protein, 16 aa, Artificial Sequence
  Description of Artificial Sequence: Synthetic peptide
DAQKIAIDKLFSMLKD

SEQ ID NO: 7848 - protein, 16 aa, Artificial Sequence
  Description of Artificial Sequence: Synthetic peptide
NHVNEALKALKQIKEE

SEQ ID NO: 7849 - protein, 16 aa, Artificial Sequence
  Description of Artificial Sequence: Synthetic peptide
ERDRTHSIIKGIKDRT

SEQ ID NO: 7850 - protein, 16 aa, Artificial Sequence
  Description of Artificial Sequence: Synthetic peptide
KQVGALKSMVEDKIQK

SEQ ID NO: 7851 - protein, 16 aa, Artificial Sequence
  Description of Artificial Sequence: Synthetic peptide
VYGKTKLAGEKALQDN

SEQ ID NO: 7852 - protein, 16 aa, Artificial Sequence
  Description of Artificial Sequence: Synthetic peptide
SEAANQRLEAGKSAVE

SEQ ID NO: 7853 - protein, 16 aa, Artificial Sequence
  Description of Artificial Sequence: Synthetic peptide
KEQVQASLENMAKVVD

SEQ ID NO: 7854 - protein, 16 aa, Artificial Sequence
  Description of Artificial Sequence: Synthetic peptide
QETQKGALKEIQAFIR

SEQ ID NO: 7855 - protein, 16 aa, Artificial Sequence
  Description of Artificial Sequence: Synthetic peptide
PRAKKVLELSLREGLQ

SEQ ID NO: 7856 - protein, 16 aa, Artificial Sequence
  Description of Artificial Sequence: Synthetic peptide
KLHSQANLMRLKSDLF

SEQ ID NO: 7857 - protein, 16 aa, Artificial Sequence
  Description of Artificial Sequence: Synthetic peptide
GEAYKQQVARAVAEIR

SEQ ID NO: 7858 - protein, 16 aa, Artificial Sequence
  Description of Artificial Sequence: Synthetic peptide
KEDFGKLMTKNHELLK

SEQ ID NO: 7859 - protein, 16 aa, Artificial Sequence
  Description of Artificial Sequence: Synthetic peptide
KEAASVTRDHMVMVGT

SEQ ID NO: 7860 - protein, 16 aa, Artificial Sequence
  Description of Artificial Sequence: Synthetic peptide
RTEAANVEKITTKLLK

SEQ ID NO: 7861 - protein, 16 aa, Artificial Sequence
  Description of Artificial Sequence: Synthetic peptide
VGDDFSRVVNRQLDQT

SEQ ID NO: 7862 - protein, 16 aa, Artificial Sequence
  Description of Artificial Sequence: Synthetic peptide
AGERIVDIIATDIQTK

SEQ ID NO: 7863 - protein, 16 aa, Artificial Sequence
  Description of Artificial Sequence: Synthetic peptide
VGDAISALSRKIAKET

SEQ ID NO: 7864 - protein, 16 aa, Artificial Sequence
  Description of Artificial Sequence: Synthetic peptide
RQAIFETLVAKGRELL

SEQ ID NO: 7865 - protein, 16 aa, Artificial Sequence
  Description of Artificial Sequence: Synthetic peptide
SVGAKTLKSVIKEYNE

SEQ ID NO: 7866 - protein, 16 aa, Artificial Sequence
  Description of Artificial Sequence: Synthetic peptide
IDLQKEVEALLDKQIK

SEQ ID NO: 7867 - protein, 16 aa, Artificial Sequence
  Description of Artificial Sequence: Synthetic peptide
NASDRLLEIMRLYQKQ

SEQ ID NO: 7868 - protein, 16 aa, Artificial Sequence
  Description of Artificial Sequence: Synthetic peptide
IDAAHKEITDGVANFK

SEQ ID NO: 7869 - protein, 16 aa, Artificial Sequence
  Description of Artificial Sequence: Synthetic peptide
DEWKNKLDSLIDRIIK

SEQ ID NO: 7870 - protein, 16 aa, Artificial Sequence
  Description of Artificial Sequence: Synthetic peptide
GRESVGFLVTIKELLE

SEQ ID NO: 7871 - protein, 16 aa, Artificial Sequence
  Description of Artificial Sequence: Synthetic peptide
VEKVLKTRYHDATSKL

SEQ ID NO: 7872 - protein, 16 aa, Artificial Sequence
  Description of Artificial Sequence: Synthetic peptide
PKVINRLAHEVIEAQQ

SEQ ID NO: 7873 - protein, 16 aa, Artificial Sequence
  Description of Artificial Sequence: Synthetic peptide
SLAEMGANRLWKLIHE

SEQ ID NO: 7874 - protein, 16 aa, Artificial Sequence
  Description of Artificial Sequence: Synthetic peptide
RNDYRTLRQGIIDMVL

SEQ ID NO: 7875 - protein, 16 aa, Artificial Sequence
  Description of Artificial Sequence: Synthetic peptide
VRGRLAETLLILKENF

SEQ ID NO: 7876 - protein, 16 aa, Artificial Sequence
  Description of Artificial Sequence: Synthetic peptide
LGREKAVQEAIRDLIQ

SEQ ID NO: 7877 - protein, 16 aa, Artificial Sequence
  Description of Artificial Sequence: Synthetic peptide
SPRETLTDTIMMAKIR

SEQ ID NO: 7878 - protein, 16 aa, Artificial Sequence
  Description of Artificial Sequence: Synthetic peptide
GPDNLRKGIELAVAET

SEQ ID NO: 7879 - protein, 16 aa, Artificial Sequence
  Description of Artificial Sequence: Synthetic peptide
RETLEISYRNAIARLS

SEQ ID NO: 7880 - protein, 16 aa, Artificial Sequence
  Description of Artificial Sequence: Synthetic peptide
PADWAKKLTDAVLRQK

SEQ ID NO: 7881 - protein, 16 aa, Artificial Sequence
  Description of Artificial Sequence: Synthetic peptide
ISTLDFEIRHQLTQIH

SEQ ID NO: 7882 - protein, 16 aa, Artificial Sequence
  Description of Artificial Sequence: Synthetic peptide
KTVNMMELINNIAKEH

SEQ ID NO: 7883 - protein, 16 aa, Artificial Sequence
  Description of Artificial Sequence: Synthetic peptide
QHLHTLLDLYDKINTK

SEQ ID NO: 7884 - protein, 16 aa, Artificial Sequence
  Description of Artificial Sequence: Synthetic peptide
KPQVFANAEKIVEQLK

SEQ ID NO: 7885 - protein, 16 aa, Artificial Sequence
  Description of Artificial Sequence: Synthetic peptide
PDQQRDFQREIQILKA

SEQ ID NO: 7886 - protein, 16 aa, Artificial Sequence
  Description of Artificial Sequence: Synthetic peptide
LEGLLSQMKAIDDLVK

SEQ ID NO: 7887 - protein, 16 aa, Artificial Sequence
  Description of Artificial Sequence: Synthetic peptide
FETNVRETKRVVEAAH

SEQ ID NO: 7888 - protein, 16 aa, Artificial Sequence
  Description of Artificial Sequence: Synthetic peptide
PDDTARILREFLSDAR

SEQ ID NO: 7889 - protein, 16 aa, Artificial Sequence
  Description of Artificial Sequence: Synthetic peptide
EARQRLVEAQIKEAVL

SEQ ID NO: 7890 - protein, 16 aa, Artificial Sequence
  Description of Artificial Sequence: Synthetic peptide
KTELLRAVADRILLSA

SEQ ID NO: 7891 - protein, 16 aa, Artificial Sequence
  Description of Artificial Sequence: Synthetic peptide
PDHKATRDATLLAARE

SEQ ID NO: 7892 - protein, 16 aa, Artificial Sequence
  Description of Artificial Sequence: Synthetic peptide
ISTLDFKIRHQLTQTH

SEQ ID NO: 7893 - protein, 16 aa, Artificial Sequence
  Description of Artificial Sequence: Synthetic peptide
KSKKLEFLLKVSDRLE

SEQ ID NO: 7894 - protein, 16 aa, Artificial Sequence
  Description of Artificial Sequence: Synthetic peptide
ASLVKSRLEHELGRIR

SEQ ID NO: 7895 - protein, 16 aa, Artificial Sequence
  Description of Artificial Sequence: Synthetic peptide
FVENAIIKARHAAKQT

SEQ ID NO: 7896 - protein, 16 aa, Artificial Sequence
  Description of Artificial Sequence: Synthetic peptide
LAARKDFQREAELLTN

SEQ ID NO: 7897 - protein, 16 aa, Artificial Sequence
  Description of Artificial Sequence: Synthetic peptide
NQRAAIVEKKIELAKT

SEQ ID NO: 7898 - protein, 16 aa, Artificial Sequence
  Description of Artificial Sequence: Synthetic peptide
DEAVAKFSTAINELKA

SEQ ID NO: 7899 - protein, 16 aa, Artificial Sequence
  Description of Artificial Sequence: Synthetic peptide
DSTRETVLKQIREFLE

SEQ ID NO: 7900 - protein, 16 aa, Artificial Sequence
  Description of Artificial Sequence: Synthetic peptide
EMEREQLEVLKQRGIA

SEQ ID NO: 7901 - protein, 16 aa, Artificial Sequence
  Description of Artificial Sequence: Synthetic peptide
MDERNRQIAEIGASLI

SEQ ID NO: 7902 - protein, 16 aa, Artificial Sequence
  Description of Artificial Sequence: Synthetic peptide
ALNEKLVKETLQLAEQ

SEQ ID NO: 7903 - protein, 16 aa, Artificial Sequence
  Description of Artificial Sequence: Synthetic peptide
RDELVEKVNKTLAKRL

SEQ ID NO: 7904 - protein, 16 aa, Artificial Sequence
  Description of Artificial Sequence: Synthetic peptide
KEAKNAAAKLAVEILN

SEQ ID NO: 7905 - protein, 16 aa, Artificial Sequence
  Description of Artificial Sequence: Synthetic peptide
ADAMNREVSSLKNKLR

SEQ ID NO: 7906 - protein, 16 aa, Artificial Sequence
  Description of Artificial Sequence: Synthetic peptide
HRLIDQATAEIVETAK

SEQ ID NO: 7907 - protein, 16 aa, Artificial Sequence
  Description of Artificial Sequence: Synthetic peptide
PKFKKILSLMDHVEEQ

SEQ ID NO: 7908 - protein, 16 aa, Artificial Sequence
  Description of Artificial Sequence: Synthetic peptide
QAAASEWRARVVDALK

SEQ ID NO: 7909 - protein, 16 aa, Artificial Sequence
  Description of Artificial Sequence: Synthetic peptide
TQGVKRMNGFIQAHRE

SEQ ID NO: 7910 - protein, 16 aa, Artificial Sequence
  Description of Artificial Sequence: Synthetic peptide
VANAVQKIKGIVETEH

SEQ ID NO: 7911 - protein, 16 aa, Artificial Sequence
  Description of Artificial Sequence: Synthetic peptide
MDSKKYVQLKHKAAAE

SEQ ID NO: 7912 - protein, 16 aa, Artificial Sequence
  Description of Artificial Sequence: Synthetic peptide
SKTGEKIMQLLKKLNE

SEQ ID NO: 7913 - protein, 16 aa, Artificial Sequence
  Description of Artificial Sequence: Synthetic peptide
RTELKEIVTSDLKQLL

SEQ ID NO: 7914 - protein, 16 aa, Artificial Sequence
  Description of Artificial Sequence: Synthetic peptide
GRVVLDEAVKLLKQAS

SEQ ID NO: 7915 - protein, 16 aa, Artificial Sequence
  Description of Artificial Sequence: Synthetic peptide
RELMETGRSVVQKYLN

SEQ ID NO: 7916 - protein, 16 aa, Artificial Sequence
  Description of Artificial Sequence: Synthetic peptide
QELELSLNMAFARARE

SEQ ID NO: 7917 - protein, 16 aa, Artificial Sequence
  Description of Artificial Sequence: Synthetic peptide
PQVDKVREATEIATGL

SEQ ID NO: 7918 - protein, 16 aa, Artificial Sequence
  Description of Artificial Sequence: Synthetic peptide
GHEKLTQARNQLLAEA

SEQ ID NO: 7919 - protein, 16 aa, Artificial Sequence
  Description of Artificial Sequence: Synthetic peptide
LEKTRELKEVLNKVKY

SEQ ID NO: 7920 - protein, 16 aa, Artificial Sequence
  Description of Artificial Sequence: Synthetic peptide
PLTVKKHLRAQAIALE

SEQ ID NO: 7921 - protein, 16 aa, Artificial Sequence
  Description of Artificial Sequence: Synthetic peptide
NQLQNGIKRVKEFLES

SEQ ID NO: 7922 - protein, 16 aa, Artificial Sequence
  Description of Artificial Sequence: Synthetic peptide
STVAEKSLTELLKSLH

SEQ ID NO: 7923 - protein, 16 aa, Artificial Sequence
  Description of Artificial Sequence: Synthetic peptide
DTHRRLVMETLIKAGD

SEQ ID NO: 7924 - protein, 16 aa, Artificial Sequence
  Description of Artificial Sequence: Synthetic peptide
ENVKKKLSLALEAAKM

SEQ ID NO: 7925 - protein, 16 aa, Artificial Sequence
  Description of Artificial Sequence: Synthetic peptide
ADLVKFGQRLRELRTA

SEQ ID NO: 7926 - protein, 16 aa, Artificial Sequence
  Description of Artificial Sequence: Synthetic peptide
GPKVRTWLSENGEERL

SEQ ID NO: 7927 - protein, 16 aa, Artificial Sequence
  Description of Artificial Sequence: Synthetic peptide
SIIRDLTDAAVKMVRV

SEQ ID NO: 7928 - protein, 16 aa, Artificial Sequence
  Description of Artificial Sequence: Synthetic peptide
REAAVEQLKSIREDIV

SEQ ID NO: 7929 - protein, 17 aa, Artificial Sequence
  Description of Artificial Sequence: Synthetic peptide
AKGQQEAARAGELLKEK

SEQ ID NO: 7930 - protein, 17 aa, Artificial Sequence
  Description of Artificial Sequence: Synthetic peptide
DEHAVEAVRGGQYILQR

SEQ ID NO: 7931 - protein, 17 aa, Artificial Sequence
  Description of Artificial Sequence: Synthetic peptide
RDAGQLYSKGMESLKVM

SEQ ID NO: 7932 - protein, 17 aa, Artificial Sequence
  Description of Artificial Sequence: Synthetic peptide
TAIIDQILKLRLEKAKL

SEQ ID NO: 7933 - protein, 17 aa, Artificial Sequence
  Description of Artificial Sequence: Synthetic peptide
FETVRSAAKTIREALDA

SEQ ID NO: 7934 - protein, 17 aa, Artificial Sequence
  Description of Artificial Sequence: Synthetic peptide
LAEAQADFLTRVLQRLE

SEQ ID NO: 7935 - protein, 17 aa, Artificial Sequence
  Description of Artificial Sequence: Synthetic peptide
SAAIREMLGHFSDANQK

SEQ ID NO: 7936 - protein, 17 aa, Artificial Sequence
  Description of Artificial Sequence: Synthetic peptide
RTGTFIVIDILIDIIRE

SEQ ID NO: 7937 - protein, 17 aa, Artificial Sequence
  Description of Artificial Sequence: Synthetic peptide
NETRKSLIAGHMTEIMQ

SEQ ID NO: 7938 - protein, 17 aa, Artificial Sequence
  Description of Artificial Sequence: Synthetic peptide
SGERDRTHSIIKGIKDR

SEQ ID NO: 7939 - protein, 17 aa, Artificial Sequence
  Description of Artificial Sequence: Synthetic peptide
FKQLVEALDKVLLAVSE

SEQ ID NO: 7940 - protein, 17 aa, Artificial Sequence
  Description of Artificial Sequence: Synthetic peptide
SEVDIQGSMAYAKALEK

SEQ ID NO: 7941 - protein, 17 aa, Artificial Sequence
  Description of Artificial Sequence: Synthetic peptide
SLLKRTWEQAVKGLNES

SEQ ID NO: 7942 - protein, 17 aa, Artificial Sequence
  Description of Artificial Sequence: Synthetic peptide
PVDQATLTAFRDMRAAH

SEQ ID NO: 7943 - protein, 17 aa, Artificial Sequence
  Description of Artificial Sequence: Synthetic peptide
ASERGRLLNRLADLIER

SEQ ID NO: 7944 - protein, 17 aa, Artificial Sequence
  Description of Artificial Sequence: Synthetic peptide
DREKALELAVAQIEKSY

SEQ ID NO: 7945 - protein, 17 aa, Artificial Sequence
  Description of Artificial Sequence: Synthetic peptide
PDREKALELAVAQIEKS

SEQ ID NO: 7946 - protein, 17 aa, Artificial Sequence
  Description of Artificial Sequence: Synthetic peptide
GETKTKYDAMKKDNVES

SEQ ID NO: 7947 - protein, 17 aa, Artificial Sequence
  Description of Artificial Sequence: Synthetic peptide
KAELQKAAQDAKAAYEA

SEQ ID NO: 7948 - protein, 17 aa, Artificial Sequence
  Description of Artificial Sequence: Synthetic peptide
LEAVMDAIRTTVTHWVK

SEQ ID NO: 7949 - protein, 17 aa, Artificial Sequence
  Description of Artificial Sequence: Synthetic peptide
VKETVEAMRVVEATLSA

SEQ ID NO: 7950 - protein, 17 aa, Artificial Sequence
  Description of Artificial Sequence: Synthetic peptide
VSTNVTTAERLVRAAHK

SEQ ID NO: 7951 - protein, 17 aa, Artificial Sequence
  Description of Artificial Sequence: Synthetic peptide
ATLEAEYNLERAQKAVN

SEQ ID NO: 7952 - protein, 17 aa, Artificial Sequence
  Description of Artificial Sequence: Synthetic peptide
AAQVKDALTKMRAAALD

SEQ ID NO: 7953 - protein, 17 aa, Artificial Sequence
  Description of Artificial Sequence: Synthetic peptide
ASDKLWVTRVIAHELAH

SEQ ID NO: 7954 - protein, 17 aa, Artificial Sequence
  Description of Artificial Sequence: Synthetic peptide
AEKLFNQDVDAAVRGIL

SEQ ID NO: 7955 - protein, 17 aa, Artificial Sequence
  Description of Artificial Sequence: Synthetic peptide
IQEHINRLVAIRAQADI

SEQ ID NO: 7956 - protein, 17 aa, Artificial Sequence
  Description of Artificial Sequence: Synthetic peptide
KAESDAAYERQARKILE

SEQ ID NO: 7957 - protein, 17 aa, Artificial Sequence
  Description of Artificial Sequence: Synthetic peptide
GTDLMNFLKTVRSTTEK

SEQ ID NO: 7958 - protein, 17 aa, Artificial Sequence
  Description of Artificial Sequence: Synthetic peptide
NDEMKAVADAYKQVLKD

SEQ ID NO: 7959 - protein, 17 aa, Artificial Sequence
  Description of Artificial Sequence: Synthetic peptide
KESVEAMIIAGKSANEH

SEQ ID NO: 7960 - protein, 17 aa, Artificial Sequence
  Description of Artificial Sequence: Synthetic peptide
WDKTGDILAEAALGLQR

SEQ ID NO: 7961 - protein, 17 aa, Artificial Sequence
  Description of Artificial Sequence: Synthetic peptide
SAARERGEGFQQAVAAH

SEQ ID NO: 7962 - protein, 17 aa, Artificial Sequence
  Description of Artificial Sequence: Synthetic peptide
AKEALEQARQNVEKTAE

SEQ ID NO: 7963 - protein, 17 aa, Artificial Sequence
  Description of Artificial Sequence: Synthetic peptide
MLAYSEMIAEKVRTAAR

SEQ ID NO: 7964 - protein, 17 aa, Artificial Sequence
  Description of Artificial Sequence: Synthetic peptide
HEYHAETIKNVRTATES

SEQ ID NO: 7965 - protein, 17 aa, Artificial Sequence
  Description of Artificial Sequence: Synthetic peptide
RETVRVMAEVSALEATA

SEQ ID NO: 7966 - protein, 17 aa, Artificial Sequence
  Description of Artificial Sequence: Synthetic peptide
TTELTMIANRIRELMEA

SEQ ID NO: 7967 - protein, 17 aa, Artificial Sequence
  Description of Artificial Sequence: Synthetic peptide
RGKVERSIKIVDEYLSA

SEQ ID NO: 7968 - protein, 17 aa, Artificial Sequence
  Description of Artificial Sequence: Synthetic peptide
AKEIAQLVQDYTQHNGR

SEQ ID NO: 7969 - protein, 17 aa, Artificial Sequence
  Description of Artificial Sequence: Synthetic peptide
GPDGDAVVSLAKEYSKT

SEQ ID NO: 7970 - protein, 17 aa, Artificial Sequence
  Description of Artificial Sequence: Synthetic peptide
VAALIAERERVTTSLND

SEQ ID NO: 7971 - protein, 17 aa, Artificial Sequence
  Description of Artificial Sequence: Synthetic peptide
LHLVDLARFAVTEHNKK

SEQ ID NO: 7972 - protein, 17 aa, Artificial Sequence
  Description of Artificial Sequence: Synthetic peptide
SAARERGEGFKQAIEAH

SEQ ID NO: 7973 - protein, 17 aa, Artificial Sequence
  Description of Artificial Sequence: Synthetic peptide
REQVVVRLLDMLTKAAS

SEQ ID NO: 7974 - protein, 17 aa, Artificial Sequence
  Description of Artificial Sequence: Synthetic peptide
QAVVQKSLAAIADDSKK

SEQ ID NO: 7975 - protein, 17 aa, Artificial Sequence
  Description of Artificial Sequence: Synthetic peptide
MDERNRQIAEIGASLIK

SEQ ID NO: 7976 - protein, 17 aa, Artificial Sequence
  Description of Artificial Sequence: Synthetic peptide
RHVDYVADQIVTKLVDV

SEQ ID NO: 7977 - protein, 17 aa, Artificial Sequence
  Description of Artificial Sequence: Synthetic peptide
AVDQRRAARTGMAFEML

SEQ ID NO: 7978 - protein, 17 aa, Artificial Sequence
  Description of Artificial Sequence: Synthetic peptide
AVLDDWLKQKGLKNQAL

SEQ ID NO: 7979 - protein, 17 aa, Artificial Sequence
  Description of Artificial Sequence: Synthetic peptide
QQLVTDIIHLARVARDS

SEQ ID NO: 7980 - protein, 17 aa, Artificial Sequence
  Description of Artificial Sequence: Synthetic peptide
NAVSLVMRRIRKENVDA

SEQ ID NO: 7981 - protein, 17 aa, Artificial Sequence
  Description of Artificial Sequence: Synthetic peptide
RELTEKAFSLVKLALRD

SEQ ID NO: 7982 - protein, 17 aa, Artificial Sequence
  Description of Artificial Sequence: Synthetic peptide
KDSLGETAFNMLLDRIV

SEQ ID NO: 7983 - protein, 17 aa, Artificial Sequence
  Description of Artificial Sequence: Synthetic peptide
LEKNFQAAKNMIERAGE

SEQ ID NO: 7984 - protein, 17 aa, Artificial Sequence
  Description of Artificial Sequence: Synthetic peptide
ANLTATYRKLEEMAKQV

SEQ ID NO: 7985 - protein, 17 aa, Artificial Sequence
  Description of Artificial Sequence: Synthetic peptide
DSGIKRIAEAAWQVNES

SEQ ID NO: 7986 - protein, 17 aa, Artificial Sequence
  Description of Artificial Sequence: Synthetic peptide
AAERGRVLMRLSARVTD

SEQ ID NO: 7987 - protein, 17 aa, Artificial Sequence
  Description of Artificial Sequence: Synthetic peptide
KPQLDKVLGFVAQAKKE

SEQ ID NO: 7988 - protein, 17 aa, Artificial Sequence
  Description of Artificial Sequence: Synthetic peptide
DKDRANLINNIFELAGL

SEQ ID NO: 7989 - protein, 17 aa, Artificial Sequence
  Description of Artificial Sequence: Synthetic peptide
PLAIHALLERMNEQKAK

SEQ ID NO: 7990 - protein, 17 aa, Artificial Sequence
  Description of Artificial Sequence: Synthetic peptide
QWVKDAMQHLDRQAAAL

SEQ ID NO: 7991 - protein, 17 aa, Artificial Sequence
  Description of Artificial Sequence: Synthetic peptide
ARHRELAAGIEAWATQH

SEQ ID NO: 7992 - protein, 17 aa, Artificial Sequence
  Description of Artificial Sequence: Synthetic peptide
STNESVKNLLLERVKES

SEQ ID NO: 7993 - protein, 17 aa, Artificial Sequence
  Description of Artificial Sequence: Synthetic peptide
RNNMQHVAGITEAAKET

SEQ ID NO: 7994 - protein, 17 aa, Artificial Sequence
  Description of Artificial Sequence: Synthetic peptide
EEHFKVLVKMTAQELAN

SEQ ID NO: 7995 - protein, 17 aa, Artificial Sequence
  Description of Artificial Sequence: Synthetic peptide
SAERIRQLKTVLGKMQE

SEQ ID NO: 7996 - protein, 17 aa, Artificial Sequence
  Description of Artificial Sequence: Synthetic peptide
ETLKLETAKAILHGFQT

SEQ ID NO: 7997 - protein, 17 aa, Artificial Sequence
  Description of Artificial Sequence: Synthetic peptide
LSLLMKNADTAMYHAKE

SEQ ID NO: 7998 - protein, 17 aa, Artificial Sequence
  Description of Artificial Sequence: Synthetic peptide
YADVELNSRKVAAGLHK

SEQ ID NO: 7999 - protein, 17 aa, Artificial Sequence
  Description of Artificial Sequence: Synthetic peptide
ETDEYQLLQVKKLIALS

SEQ ID NO: 8000 - protein, 17 aa, Artificial Sequence
  Description of Artificial Sequence: Synthetic peptide
VVLAEKAQQIAKILVKE

SEQ ID NO: 8001 - protein, 17 aa, Artificial Sequence
  Description of Artificial Sequence: Synthetic peptide
ESLVMAGDLVIKTAKKH

SEQ ID NO: 8002 - protein, 17 aa, Artificial Sequence
  Description of Artificial Sequence: Synthetic peptide
KEGVYGLARTLLHLAQE

SEQ ID NO: 8003 - protein, 17 aa, Artificial Sequence
  Description of Artificial Sequence: Synthetic peptide
VQDRAALIHKIADGIQA

SEQ ID NO: 8004 - protein, 17 aa, Artificial Sequence
  Description of Artificial Sequence: Synthetic peptide
EASIAISQARLDEKIAQ

SEQ ID NO: 8005 - protein, 17 aa, Artificial Sequence
  Description of Artificial Sequence: Synthetic peptide
KEQKAELVLNALVAIRY

SEQ ID NO: 8006 - protein, 17 aa, Artificial Sequence
  Description of Artificial Sequence: Synthetic peptide
PLEEKTIRAVARAHHET

SEQ ID NO: 8007 - protein, 17 aa, Artificial Sequence
  Description of Artificial Sequence: Synthetic peptide
ADMRSQRAQLAKGVFDR

SEQ ID NO: 8008 - protein, 17 aa, Artificial Sequence
  Description of Artificial Sequence: Synthetic peptide
TDLRIAFIAEVRKVANE

SEQ ID NO: 8009 - protein, 17 aa, Artificial Sequence
  Description of Artificial Sequence: Synthetic peptide
GKQASEVFAVLINKDKA

SEQ ID NO: 8010 - protein, 17 aa, Artificial Sequence
  Description of Artificial Sequence: Synthetic peptide
NQVLNKVKADKSLEANN

SEQ ID NO: 8011 - protein, 17 aa, Artificial Sequence
  Description of Artificial Sequence: Synthetic peptide
LAQVREEVTAKYAELKA

SEQ ID NO: 8012 - protein, 17 aa, Artificial Sequence
  Description of Artificial Sequence: Synthetic peptide
VEEKTELFNVVVSLIRA

SEQ ID NO: 8013 - protein, 17 aa, Artificial Sequence
  Description of Artificial Sequence: Synthetic peptide
MDELNRQIAEIGASLIK

SEQ ID NO: 8014 - protein, 17 aa, Artificial Sequence
  Description of Artificial Sequence: Synthetic peptide
HEYHQTTINNVRQAAAE

SEQ ID NO: 8015 - protein, 17 aa, Artificial Sequence
  Description of Artificial Sequence: Synthetic peptide
GERIKKIVNDILGGKNA

SEQ ID NO: 8016 - protein, 17 aa, Artificial Sequence
  Description of Artificial Sequence: Synthetic peptide
LEPFLAQMKALDDLIKS

SEQ ID NO: 8017 - protein, 17 aa, Artificial Sequence
  Description of Artificial Sequence: Synthetic peptide
MKQTESHAVKIVVEAAR

SEQ ID NO: 8018 - protein, 17 aa, Artificial Sequence
  Description of Artificial Sequence: Synthetic peptide
DFITSKLLSGAEDALLR

SEQ ID NO: 8019 - protein, 17 aa, Artificial Sequence
  Description of Artificial Sequence: Synthetic peptide
TDLRLAFTALIREALNK

SEQ ID NO: 8020 - protein, 17 aa, Artificial Sequence
  Description of Artificial Sequence: Synthetic peptide
PKVINRLAHEVIEAQQA

SEQ ID NO: 8021 - protein, 17 aa, Artificial Sequence
  Description of Artificial Sequence: Synthetic peptide
FETNVRETRRVVEAAHA

SEQ ID NO: 8022 - protein, 17 aa, Artificial Sequence
  Description of Artificial Sequence: Synthetic peptide
EELAIQNARLAISIARK

SEQ ID NO: 8023 - protein, 17 aa, Artificial Sequence
  Description of Artificial Sequence: Synthetic peptide
EQGNREARQAGQLLKEA

SEQ ID NO: 8024 - protein, 17 aa, Artificial Sequence
  Description of Artificial Sequence: Synthetic peptide
GTKVTKMEDDIKKLLGR

SEQ ID NO: 8025 - protein, 17 aa, Artificial Sequence
  Description of Artificial Sequence: Synthetic peptide
QRAKKAIDLAFESAKSL

SEQ ID NO: 8026 - protein, 17 aa, Artificial Sequence
  Description of Artificial Sequence: Synthetic peptide
KESQVRTAKILNVLKET

SEQ ID NO: 8027 - protein, 17 aa, Artificial Sequence
  Description of Artificial Sequence: Synthetic peptide
PLEAVRMQNLIAREAEA

SEQ ID NO: 8028 - protein, 17 aa, Artificial Sequence
  Description of Artificial Sequence: Synthetic peptide
ARDIDTWANVTARSIRA

SEQ ID NO: 8029 - protein, 17 aa, Artificial Sequence
  Description of Artificial Sequence: Synthetic peptide
VVTDVRDFLAARAQALR

SEQ ID NO: 8030 - protein, 17 aa, Artificial Sequence
  Description of Artificial Sequence: Synthetic peptide
AEKAQAIAAARNTFARD

SEQ ID NO: 8031 - protein, 17 aa, Artificial Sequence
  Description of Artificial Sequence: Synthetic peptide
GATHEIQRMIGRAMRTA

SEQ ID NO: 8032 - protein, 17 aa, Artificial Sequence
  Description of Artificial Sequence: Synthetic peptide
TEASIAKAKRLIKLYND

SEQ ID NO: 8033 - protein, 17 aa, Artificial Sequence
  Description of Artificial Sequence: Synthetic peptide
VEAVRHMRLMNEAIAQL

SEQ ID NO: 8034 - protein, 17 aa, Artificial Sequence
  Description of Artificial Sequence: Synthetic peptide
KTDNLKIGKDYLEDVIN

SEQ ID NO: 8035 - protein, 17 aa, Artificial Sequence
  Description of Artificial Sequence: Synthetic peptide
AVTAKLDESLTKVIDFI

SEQ ID NO: 8036 - protein, 17 aa, Artificial Sequence
  Description of Artificial Sequence: Synthetic peptide
DREKALELAMAQIDKNF

SEQ ID NO: 8037 - protein, 17 aa, Artificial Sequence
  Description of Artificial Sequence: Synthetic peptide
NELGRINKIIAEVAEKF

SEQ ID NO: 8038 - protein, 17 aa, Artificial Sequence
  Description of Artificial Sequence: Synthetic peptide
VDVFKTKAQPLIKHILT

SEQ ID NO: 8039 - protein, 17 aa, Artificial Sequence
  Description of Artificial Sequence: Synthetic peptide
LSAAQTLRAAFIKAEKE

SEQ ID NO: 8040 - protein, 17 aa, Artificial Sequence
  Description of Artificial Sequence: Synthetic peptide
LDDLEKARTVLENRINA

SEQ ID NO: 8041 - protein, 17 aa, Artificial Sequence
  Description of Artificial Sequence: Synthetic peptide
AGEQAIRQILDEAGKVG

SEQ ID NO: 8042 - protein, 17 aa, Artificial Sequence
  Description of Artificial Sequence: Synthetic peptide
GLQRAKTGTDKTLVKEV

SEQ ID NO: 8043 - protein, 17 aa, Artificial Sequence
  Description of Artificial Sequence: Synthetic peptide
GTQLEKLMENMRNDIAS

SEQ ID NO: 8044 - protein, 17 aa, Artificial Sequence
  Description of Artificial Sequence: Synthetic peptide
DSIRLLALLSLGEVGHH

SEQ ID NO: 8045 - protein, 17 aa, Artificial Sequence
  Description of Artificial Sequence: Synthetic peptide
IPSISIMLHELIKLLHH

SEQ ID NO: 8046 - protein, 17 aa, Artificial Sequence
  Description of Artificial Sequence: Synthetic peptide
LDDVKALHSKLTSVFAT

SEQ ID NO: 8047 - protein, 17 aa, Artificial Sequence
  Description of Artificial Sequence: Synthetic peptide
SKESGVIQGDLIAKHWQ

SEQ ID NO: 8048 - protein, 17 aa, Artificial Sequence
  Description of Artificial Sequence: Synthetic peptide
TYARAEKALVDIVRHSQ

SEQ ID NO: 8049 - protein, 17 aa, Artificial Sequence
  Description of Artificial Sequence: Synthetic peptide
TNERIAQRALEGFTRSL

SEQ ID NO: 8050 - protein, 17 aa, Artificial Sequence
  Description of Artificial Sequence: Synthetic peptide
ALQKEQAKLSLESWADV

SEQ ID NO: 8051 - protein, 17 aa, Artificial Sequence
  Description of Artificial Sequence: Synthetic peptide
VVDRFLADLQDAVAQVR

SEQ ID NO: 8052 - protein, 17 aa, Artificial Sequence
  Description of Artificial Sequence: Synthetic peptide
REELGRHSWAVLHTLAA

SEQ ID NO: 8053 - protein, 17 aa, Artificial Sequence
  Description of Artificial Sequence: Synthetic peptide
LPTAKDELTKALDLLNS

SEQ ID NO: 8054 - protein, 17 aa, Artificial Sequence
  Description of Artificial Sequence: Synthetic peptide
RLELKALEVAARTSILT

SEQ ID NO: 8055 - protein, 17 aa, Artificial Sequence
  Description of Artificial Sequence: Synthetic peptide
ASERGQLIYKLADLIER

SEQ ID NO: 8056 - protein, 17 aa, Artificial Sequence
  Description of Artificial Sequence: Synthetic peptide
ASHRGRLLNRLADLIER

SEQ ID NO: 8057 - protein, 17 aa, Artificial Sequence
  Description of Artificial Sequence: Synthetic peptide
DAGVLDAYTHHTERLKS

SEQ ID NO: 8058 - protein, 17 aa, Artificial Sequence
  Description of Artificial Sequence: Synthetic peptide
GESRVISVAEVKGLVEQ

SEQ ID NO: 8059 - protein, 17 aa, Artificial Sequence
  Description of Artificial Sequence: Synthetic peptide
KEEALELINGYIQKIKS

SEQ ID NO: 8060 - protein, 17 aa, Artificial Sequence
  Description of Artificial Sequence: Synthetic peptide
DKGQKIAQQIKSIIDIM

SEQ ID NO: 8061 - protein, 17 aa, Artificial Sequence
  Description of Artificial Sequence: Synthetic peptide
YIELDRLSTNLATRLAE

SEQ ID NO: 8062 - protein, 17 aa, Artificial Sequence
  Description of Artificial Sequence: Synthetic peptide
PEVAAEVIKDLVNTVRS

SEQ ID NO: 8063 - protein, 17 aa, Artificial Sequence
  Description of Artificial Sequence: Synthetic peptide
WEDTDALLRQLANAVKA

SEQ ID NO: 8064 - protein, 17 aa, Artificial Sequence
  Description of Artificial Sequence: Synthetic peptide
IEAATHVGKQIVEKILK

SEQ ID NO: 8065 - protein, 17 aa, Artificial Sequence
  Description of Artificial Sequence: Synthetic peptide
DETIELLLNSVKAAFGK

SEQ ID NO: 8066 - protein, 17 aa, Artificial Sequence
  Description of Artificial Sequence: Synthetic peptide
QADRKAEKIIFNELSKA

SEQ ID NO: 8067 - protein, 17 aa, Artificial Sequence
  Description of Artificial Sequence: Synthetic peptide
TEAAAEQGAKLLAKFRQ

SEQ ID NO: 8068 - protein, 17 aa, Artificial Sequence
  Description of Artificial Sequence: Synthetic peptide
IKESIKELVEELSMFAK

SEQ ID NO: 8069 - protein, 17 aa, Artificial Sequence
  Description of Artificial Sequence: Synthetic peptide
SRLSGALNRAEGLMEEL

SEQ ID NO: 8070 - protein, 17 aa, Artificial Sequence
  Description of Artificial Sequence: Synthetic peptide
LENLADGYKHMSLALNR

SEQ ID NO: 8071 - protein, 17 aa, Artificial Sequence
  Description of Artificial Sequence: Synthetic peptide
AREMANAKEIARTVQIM

SEQ ID NO: 8072 - protein, 17 aa, Artificial Sequence
  Description of Artificial Sequence: Synthetic peptide
AEKIDRWVILNSIKLLA

SEQ ID NO: 8073 - protein, 17 aa, Artificial Sequence
  Description of Artificial Sequence: Synthetic peptide
AHVKSHGAKVLASFSEG

SEQ ID NO: 8074 - protein, 17 aa, Artificial Sequence
  Description of Artificial Sequence: Synthetic peptide
SAAIHRLVDTSEKLSKK

SEQ ID NO: 8075 - protein, 17 aa, Artificial Sequence
  Description of Artificial Sequence: Synthetic peptide
RSERAEANLKLLLNAFE

SEQ ID NO: 8076 - protein, 17 aa, Artificial Sequence
  Description of Artificial Sequence: Synthetic peptide
TREAVAKLTAARLAADV

SEQ ID NO: 8077 - protein, 17 aa, Artificial Sequence
  Description of Artificial Sequence: Synthetic peptide
HEYHQTTINNLRAAATE

SEQ ID NO: 8078 - protein, 17 aa, Artificial Sequence
  Description of Artificial Sequence: Synthetic peptide
DVSLELLTKGRSLANEL

SEQ ID NO: 8079 - protein, 17 aa, Artificial Sequence
  Description of Artificial Sequence: Synthetic peptide
QEEALELINGYIQKIKS

SEQ ID NO: 8080 - protein, 17 aa, Artificial Sequence
  Description of Artificial Sequence: Synthetic peptide
PDKNYSKAEKLIKEASK

SEQ ID NO: 8081 - protein, 17 aa, Artificial Sequence
  Description of Artificial Sequence: Synthetic peptide
DNDRAFTIKKLAELVKE

SEQ ID NO: 8082 - protein, 17 aa, Artificial Sequence
  Description of Artificial Sequence: Synthetic peptide
LTKFGELLNASHASLKD

SEQ ID NO: 8083 - protein, 17 aa, Artificial Sequence
  Description of Artificial Sequence: Synthetic peptide
ANDKNAFILNKIKVIHG

SEQ ID NO: 8084 - protein, 17 aa, Artificial Sequence
  Description of Artificial Sequence: Synthetic peptide
VDEAMSFAEVLKQVKSL

SEQ ID NO: 8085 - protein, 17 aa, Artificial Sequence
  Description of Artificial Sequence: Synthetic peptide
LVEKNLKIFKGIVSEVM

SEQ ID NO: 8086 - protein, 17 aa, Artificial Sequence
  Description of Artificial Sequence: Synthetic peptide
VKSARIARNTQIIIQEE

SEQ ID NO: 8087 - protein, 17 aa, Artificial Sequence
  Description of Artificial Sequence: Synthetic peptide
IDEALAFAEILKQIKSM

SEQ ID NO: 8088 - protein, 17 aa, Artificial Sequence
  Description of Artificial Sequence: Synthetic peptide
QTRIKELVKVAQEVGAA

SEQ ID NO: 8089 - protein, 17 aa, Artificial Sequence
  Description of Artificial Sequence: Synthetic peptide
AQVKDALTKMRAAALDA

SEQ ID NO: 8090 - protein, 17 aa, Artificial Sequence
  Description of Artificial Sequence: Synthetic peptide
AKALKAVQDKLKAFVES

SEQ ID NO: 8091 - protein, 17 aa, Artificial Sequence
  Description of Artificial Sequence: Synthetic peptide
RDRAQAVETYLKKLIAT

SEQ ID NO: 8092 - protein, 17 aa, Artificial Sequence
  Description of Artificial Sequence: Synthetic peptide
IPELTNLKNALEAKSKE

SEQ ID NO: 8093 - protein, 17 aa, Artificial Sequence
  Description of Artificial Sequence: Synthetic peptide
PKVGREAITSIIDTLET

SEQ ID NO: 8094 - protein, 17 aa, Artificial Sequence
  Description of Artificial Sequence: Synthetic peptide
KESGIIQGDLIAKHWAA

SEQ ID NO: 8095 - protein, 17 aa, Artificial Sequence
  Description of Artificial Sequence: Synthetic peptide
VTVKRNSANVIAHEIAH

SEQ ID NO: 8096 - protein, 17 aa, Artificial Sequence
  Description of Artificial Sequence: Synthetic peptide
RTEAANVEKITTKLLKA

SEQ ID NO: 8097 - protein, 17 aa, Artificial Sequence
  Description of Artificial Sequence: Synthetic peptide
TARVETVIGIADTFLKR

SEQ ID NO: 8098 - protein, 17 aa, Artificial Sequence
  Description of Artificial Sequence: Synthetic peptide
REEAISNMVVALKELSI

SEQ ID NO: 8099 - protein, 17 aa, Artificial Sequence
  Description of Artificial Sequence: Synthetic peptide
KKIAEDVKTAGATIIKN

SEQ ID NO: 8100 - protein, 17 aa, Artificial Sequence
  Description of Artificial Sequence: Synthetic peptide
IAAQKNDDDRQARALAA

SEQ ID NO: 8101 - protein, 17 aa, Artificial Sequence
  Description of Artificial Sequence: Synthetic peptide
EDVQLTLRNMALEAFKA

SEQ ID NO: 8102 - protein, 17 aa, Artificial Sequence
  Description of Artificial Sequence: Synthetic peptide
SDSRMAMTGAIRKVFVE

SEQ ID NO: 8103 - protein, 17 aa, Artificial Sequence
  Description of Artificial Sequence: Synthetic peptide
KDASEMIKKAVEMTISS

SEQ ID NO: 8104 - protein, 17 aa, Artificial Sequence
  Description of Artificial Sequence: Synthetic peptide
KGPKVRTWLSENGEERL

SEQ ID NO: 8105 - protein, 17 aa, Artificial Sequence
  Description of Artificial Sequence: Synthetic peptide
PDTFKELKQGAHALKLA

SEQ ID NO: 8106 - protein, 17 aa, Artificial Sequence
  Description of Artificial Sequence: Synthetic peptide
PELLAHGRQKILDLLNE

SEQ ID NO: 8107 - protein, 17 aa, Artificial Sequence
  Description of Artificial Sequence: Synthetic peptide
LETVRKATKSALEKAVE

SEQ ID NO: 8108 - protein, 17 aa, Artificial Sequence
  Description of Artificial Sequence: Synthetic peptide
QNIRLTSETQLKKLSND

SEQ ID NO: 8109 - protein, 17 aa, Artificial Sequence
  Description of Artificial Sequence: Synthetic peptide
SETVDRAFSQMKAAIRA

SEQ ID NO: 8110 - protein, 17 aa, Artificial Sequence
  Description of Artificial Sequence: Synthetic peptide
EKIVKMNTDAVDQAVTS

SEQ ID NO: 8111 - protein, 17 aa, Artificial Sequence
  Description of Artificial Sequence: Synthetic peptide
DAGREALDLAAASIRSG

SEQ ID NO: 8112 - protein, 17 aa, Artificial Sequence
  Description of Artificial Sequence: Synthetic peptide
PKMMADGIDKTLEVALT

SEQ ID NO: 8113 - protein, 17 aa, Artificial Sequence
  Description of Artificial Sequence: Synthetic peptide
RAARELQADALEQLGYQ

SEQ ID NO: 8114 - protein, 17 aa, Artificial Sequence
  Description of Artificial Sequence: Synthetic peptide
KTVKDLTKLLYETALLT

SEQ ID NO: 8115 - protein, 17 aa, Artificial Sequence
  Description of Artificial Sequence: Synthetic peptide
GTEANEAAIKIARKYGK

SEQ ID NO: 8116 - protein, 17 aa, Artificial Sequence
  Description of Artificial Sequence: Synthetic peptide
LKVQLIDKLGEVDFRLT

SEQ ID NO: 8117 - protein, 17 aa, Artificial Sequence
  Description of Artificial Sequence: Synthetic peptide
EKRQGALELIKKGYTQQ

SEQ ID NO: 8118 - protein, 17 aa, Artificial Sequence
  Description of Artificial Sequence: Synthetic peptide
PEAADKFKEINNAHAIL

SEQ ID NO: 8119 - protein, 17 aa, Artificial Sequence
  Description of Artificial Sequence: Synthetic peptide
KELAEKALQAVEIARDT

SEQ ID NO: 8120 - protein, 17 aa, Artificial Sequence
  Description of Artificial Sequence: Synthetic peptide
RKQHVAGLKALQDWAQN

SEQ ID NO: 8121 - protein, 17 aa, Artificial Sequence
  Description of Artificial Sequence: Synthetic peptide
KAAVDRALQQVTSTKDA

SEQ ID NO: 8122 - protein, 17 aa, Artificial Sequence
  Description of Artificial Sequence: Synthetic peptide
KADVDNALNAVTRAKAA

SEQ ID NO: 8123 - protein, 17 aa, Artificial Sequence
  Description of Artificial Sequence: Synthetic peptide
LDISLHVLLETFIKGLR

SEQ ID NO: 8124 - protein, 17 aa, Artificial Sequence
  Description of Artificial Sequence: Synthetic peptide
EVYGEKIVKVQELAIKT

SEQ ID NO: 8125 - protein, 17 aa, Artificial Sequence
  Description of Artificial Sequence: Synthetic peptide
RAERAGEATRSLIDKIT

SEQ ID NO: 8126 - protein, 17 aa, Artificial Sequence
  Description of Artificial Sequence: Synthetic peptide
KHAAERLQQALAQAAER

SEQ ID NO: 8127 - protein, 17 aa, Artificial Sequence
  Description of Artificial Sequence: Synthetic peptide
EQYTENLKVIVAEKLAG

SEQ ID NO: 8128 - protein, 17 aa, Artificial Sequence
  Description of Artificial Sequence: Synthetic peptide
RAEAEAEVQRSVERFKA

SEQ ID NO: 8129 - protein, 17 aa, Artificial Sequence
  Description of Artificial Sequence: Synthetic peptide
NADKQVTSILKKAGDLL

SEQ ID NO: 8130 - protein, 17 aa, Artificial Sequence
  Description of Artificial Sequence: Synthetic peptide
QETQKGALKEIQAFIRS

SEQ ID NO: 8131 - protein, 17 aa, Artificial Sequence
  Description of Artificial Sequence: Synthetic peptide
VETTRKIITNLTEGASR

SEQ ID NO: 8132 - protein, 17 aa, Artificial Sequence
  Description of Artificial Sequence: Synthetic peptide
KDGETKILKETVEELKK

SEQ ID NO: 8133 - protein, 17 aa, Artificial Sequence
  Description of Artificial Sequence: Synthetic peptide
KDVEKVIRAAAIANKET

SEQ ID NO: 8134 - protein, 17 aa, Artificial Sequence
  Description of Artificial Sequence: Synthetic peptide
GWRAAETNVAKSEAEKR

SEQ ID NO: 8135 - protein, 17 aa, Artificial Sequence
  Description of Artificial Sequence: Synthetic peptide
RLIDAHNQAVDFAVRQV

SEQ ID NO: 8136 - protein, 17 aa, Artificial Sequence
  Description of Artificial Sequence: Synthetic peptide
DETRREMGNAAVRAAKA

SEQ ID NO: 8137 - protein, 17 aa, Artificial Sequence
  Description of Artificial Sequence: Synthetic peptide
VNDLIKENVKMAVKNVV

SEQ ID NO: 8138 - protein, 17 aa, Artificial Sequence
  Description of Artificial Sequence: Synthetic peptide
EQDFAVLTAEITSKIAR

SEQ ID NO: 8139 - protein, 17 aa, Artificial Sequence
  Description of Artificial Sequence: Synthetic peptide
NQAVSILVAKVEEIFKD

SEQ ID NO: 8140 - protein, 17 aa, Artificial Sequence
  Description of Artificial Sequence: Synthetic peptide
MGALTALIRDQKARVEA

SEQ ID NO: 8141 - protein, 17 aa, Artificial Sequence
  Description of Artificial Sequence: Synthetic peptide
SRADAAVTDDARGLLAA

SEQ ID NO: 8142 - protein, 17 aa, Artificial Sequence
  Description of Artificial Sequence: Synthetic peptide
GEEKSRALAVLKAALNS

SEQ ID NO: 8143 - protein, 17 aa, Artificial Sequence
  Description of Artificial Sequence: Synthetic peptide
LAAQKTLVDGIRKEVAA

SEQ ID NO: 8144 - protein, 17 aa, Artificial Sequence
  Description of Artificial Sequence: Synthetic peptide
HEFTKLVKELEGVITKA

SEQ ID NO: 8145 - protein, 17 aa, Artificial Sequence
  Description of Artificial Sequence: Synthetic peptide
VEAALDNLMIKVYEITK

SEQ ID NO: 8146 - protein, 17 aa, Artificial Sequence
  Description of Artificial Sequence: Synthetic peptide
DGKRLENLVRGIFAGNI

SEQ ID NO: 8147 - protein, 17 aa, Artificial Sequence
  Description of Artificial Sequence: Synthetic peptide
LQATIAGKLDKLRDAQR

SEQ ID NO: 8148 - protein, 17 aa, Artificial Sequence
  Description of Artificial Sequence: Synthetic peptide
KKDAEISAGRTALLAIQ

SEQ ID NO: 8149 - protein, 17 aa, Artificial Sequence
  Description of Artificial Sequence: Synthetic peptide
ADVLKKTIKNTLDIHKS

SEQ ID NO: 8150 - protein, 17 aa, Artificial Sequence
  Description of Artificial Sequence: Synthetic peptide
LNLKQAKEEAIKELVDA

SEQ ID NO: 8151 - protein, 17 aa, Artificial Sequence
  Description of Artificial Sequence: Synthetic peptide
ETHANKIVRAYELALKV

SEQ ID NO: 8152 - protein, 17 aa, Artificial Sequence
  Description of Artificial Sequence: Synthetic peptide
HELLDESAKKIVEVAKS

SEQ ID NO: 8153 - protein, 17 aa, Artificial Sequence
  Description of Artificial Sequence: Synthetic peptide
HMASKRDKIADIQEALA

SEQ ID NO: 8154 - protein, 17 aa, Artificial Sequence
  Description of Artificial Sequence: Synthetic peptide
DDLQRAIALSLAESNRA

SEQ ID NO: 8155 - protein, 17 aa, Artificial Sequence
  Description of Artificial Sequence: Synthetic peptide
DSTAAVAVLKRAVELDA

SEQ ID NO: 8156 - protein, 17 aa, Artificial Sequence
  Description of Artificial Sequence: Synthetic peptide
EQTADQIFKLSHLLKLT

SEQ ID NO: 8157 - protein, 17 aa, Artificial Sequence
  Description of Artificial Sequence: Synthetic peptide
ITVDRLVSKALNMWGKE

SEQ ID NO: 8158 - protein, 17 aa, Artificial Sequence
  Description of Artificial Sequence: Synthetic peptide
SIDYAAEIAKDMIKKAN

SEQ ID NO: 8159 - protein, 17 aa, Artificial Sequence
  Description of Artificial Sequence: Synthetic peptide
IGERVVRAHLSVWDDVS

SEQ ID NO: 8160 - protein, 17 aa, Artificial Sequence
  Description of Artificial Sequence: Synthetic peptide
PSLAEHALKALDRIMAQ

SEQ ID NO: 8161 - protein, 17 aa, Artificial Sequence
  Description of Artificial Sequence: Synthetic peptide
KGRDILTKTIILALREV

SEQ ID NO: 8162 - protein, 17 aa, Artificial Sequence
  Description of Artificial Sequence: Synthetic peptide
ARDVDNTIKLAKALLEE

SEQ ID NO: 8163 - protein, 17 aa, Artificial Sequence
  Description of Artificial Sequence: Synthetic peptide
NAALAKFETIRAHGALR

SEQ ID NO: 8164 - protein, 17 aa, Artificial Sequence
  Description of Artificial Sequence: Synthetic peptide
HITVDRLVSKALNMWGK

SEQ ID NO: 8165 - protein, 17 aa, Artificial Sequence
  Description of Artificial Sequence: Synthetic peptide
EDMEKRANEVANLLKTL

SEQ ID NO: 8166 - protein, 17 aa, Artificial Sequence
  Description of Artificial Sequence: Synthetic peptide
DVQIQKDNLVKDAIRAN

SEQ ID NO: 8167 - protein, 17 aa, Artificial Sequence
  Description of Artificial Sequence: Synthetic peptide
KGTFAIAKAMGRGTHEH

SEQ ID NO: 8168 - protein, 17 aa, Artificial Sequence
  Description of Artificial Sequence: Synthetic peptide
RERVLEAAQGLRQALLA

SEQ ID NO: 8169 - protein, 17 aa, Artificial Sequence
  Description of Artificial Sequence: Synthetic peptide
KKAEAVATVVAAVDQAR

SEQ ID NO: 8170 - protein, 17 aa, Artificial Sequence
  Description of Artificial Sequence: Synthetic peptide
GGGTDLGKFVLAKKEEN

SEQ ID NO: 8171 - protein, 17 aa, Artificial Sequence
  Description of Artificial Sequence: Synthetic peptide
NDQLKTVVGEFTALLDK

SEQ ID NO: 8172 - protein, 17 aa, Artificial Sequence
  Description of Artificial Sequence: Synthetic peptide
LDKNYSKAEKLIKEASK

SEQ ID NO: 8173 - protein, 17 aa, Artificial Sequence
  Description of Artificial Sequence: Synthetic peptide
HHAVEQIRAKISTAIFQ

SEQ ID NO: 8174 - protein, 17 aa, Artificial Sequence
  Description of Artificial Sequence: Synthetic peptide
DQRRLDLVHTAALMLDK

SEQ ID NO: 8175 - protein, 17 aa, Artificial Sequence
  Description of Artificial Sequence: Synthetic peptide
AKEKSKFEDMAKSDKAR

SEQ ID NO: 8176 - protein, 17 aa, Artificial Sequence
  Description of Artificial Sequence: Synthetic peptide
KLGETEQEGIAGRMIRN

SEQ ID NO: 8177 - protein, 17 aa, Artificial Sequence
  Description of Artificial Sequence: Synthetic peptide
KDEVYQILEKGAAKRTT

SEQ ID NO: 8178 - protein, 17 aa, Artificial Sequence
  Description of Artificial Sequence: Synthetic peptide
IPGIVEDYRQAAQRAKR

SEQ ID NO: 8179 - protein, 17 aa, Artificial Sequence
  Description of Artificial Sequence: Synthetic peptide
PTLVNEIAKEIVNYLKK

SEQ ID NO: 8180 - protein, 17 aa, Artificial Sequence
  Description of Artificial Sequence: Synthetic peptide
QRARAVLDRAAELATIA

SEQ ID NO: 8181 - protein, 17 aa, Artificial Sequence
  Description of Artificial Sequence: Synthetic peptide
AEAEKRIQEAAVTIYKA

SEQ ID NO: 8182 - protein, 17 aa, Artificial Sequence
  Description of Artificial Sequence: Synthetic peptide
PRAKKVLELSLREALQL

SEQ ID NO: 8183 - protein, 17 aa, Artificial Sequence
  Description of Artificial Sequence: Synthetic peptide
FIQRTAHDRILPALISK

SEQ ID NO: 8184 - protein, 17 aa, Artificial Sequence
  Description of Artificial Sequence: Synthetic peptide
HRLIDQATAEIVETAKR

SEQ ID NO: 8185 - protein, 17 aa, Artificial Sequence
  Description of Artificial Sequence: Synthetic peptide
WPRVRRDIANLGQAAEA

SEQ ID NO: 8186 - protein, 17 aa, Artificial Sequence
  Description of Artificial Sequence: Synthetic peptide
PRLLGETAGLKQVEADT

SEQ ID NO: 8187 - protein, 17 aa, Artificial Sequence
  Description of Artificial Sequence: Synthetic peptide
EKTFNLAMALKVESILK

SEQ ID NO: 8188 - protein, 17 aa, Artificial Sequence
  Description of Artificial Sequence: Synthetic peptide
YGVARQLKESQDKSIDN

SEQ ID NO: 8189 - protein, 17 aa, Artificial Sequence
  Description of Artificial Sequence: Synthetic peptide
EATRAKMRAASERLGSL

SEQ ID NO: 8190 - protein, 17 aa, Artificial Sequence
  Description of Artificial Sequence: Synthetic peptide
TAHKNAVTLRVNALKEQ

SEQ ID NO: 8191 - protein, 17 aa, Artificial Sequence
  Description of Artificial Sequence: Synthetic peptide
QLAVEKGNLENKKSITE

SEQ ID NO: 8192 - protein, 17 aa, Artificial Sequence
  Description of Artificial Sequence: Synthetic peptide
YPLLVKILDSLGERKVT

SEQ ID NO: 8193 - protein, 17 aa, Artificial Sequence
  Description of Artificial Sequence: Synthetic peptide
RGHQKLINATVEKAREV

SEQ ID NO: 8194 - protein, 17 aa, Artificial Sequence
  Description of Artificial Sequence: Synthetic peptide
TAAKNAALEAVARAIER

SEQ ID NO: 8195 - protein, 17 aa, Artificial Sequence
  Description of Artificial Sequence: Synthetic peptide
PETLRQVTQHAEHVVNA

SEQ ID NO: 8196 - protein, 17 aa, Artificial Sequence
  Description of Artificial Sequence: Synthetic peptide
GAHRATYLRAIAAKITE

SEQ ID NO: 8197 - protein, 17 aa, Artificial Sequence
  Description of Artificial Sequence: Synthetic peptide
RENVDRVTEALRAALQH

SEQ ID NO: 8198 - protein, 17 aa, Artificial Sequence
  Description of Artificial Sequence: Synthetic peptide
AEAAKAEIVASFERAKN

SEQ ID NO: 8199 - protein, 17 aa, Artificial Sequence
  Description of Artificial Sequence: Synthetic peptide
TEVDIQASMAYAKALEK

SEQ ID NO: 8200 - protein, 17 aa, Artificial Sequence
  Description of Artificial Sequence: Synthetic peptide
HSSKNDIHTLLMDLNSY

SEQ ID NO: 8201 - protein, 17 aa, Artificial Sequence
  Description of Artificial Sequence: Synthetic peptide
ISSITDGLKTKIVAERL

SEQ ID NO: 8202 - protein, 17 aa, Artificial Sequence
  Description of Artificial Sequence: Synthetic peptide
SDIRDIVQSAHMRVVKE

SEQ ID NO: 8203 - protein, 17 aa, Artificial Sequence
  Description of Artificial Sequence: Synthetic peptide
FRQAHTASGKAVHLAET

SEQ ID NO: 8204 - protein, 17 aa, Artificial Sequence
  Description of Artificial Sequence: Synthetic peptide
HSSKNDIHTLLKDLNSY

SEQ ID NO: 8205 - protein, 17 aa, Artificial Sequence
  Description of Artificial Sequence: Synthetic peptide
LAVELKQSTAQAHEKAE

SEQ ID NO: 8206 - protein, 17 aa, Artificial Sequence
  Description of Artificial Sequence: Synthetic peptide
ELEAEATHRVITIANRT

SEQ ID NO: 8207 - protein, 17 aa, Artificial Sequence
  Description of Artificial Sequence: Synthetic peptide
SEVDIQASIAYAKALEK

SEQ ID NO: 8208 - protein, 17 aa, Artificial Sequence
  Description of Artificial Sequence: Synthetic peptide
KILEASVIIWRVIDDTA

SEQ ID NO: 8209 - protein, 17 aa, Artificial Sequence
  Description of Artificial Sequence: Synthetic peptide
RGQRQMEVLSAIIDKSK

SEQ ID NO: 8210 - protein, 17 aa, Artificial Sequence
  Description of Artificial Sequence: Synthetic peptide
HEKLTQARNQLLAEAAK

SEQ ID NO: 8211 - protein, 17 aa, Artificial Sequence
  Description of Artificial Sequence: Synthetic peptide
PEVHRLTHALRAATRIV

SEQ ID NO: 8212 - protein, 17 aa, Artificial Sequence
  Description of Artificial Sequence: Synthetic peptide
KDARALQADAMEQLGYQ

SEQ ID NO: 8213 - protein, 17 aa, Artificial Sequence
  Description of Artificial Sequence: Synthetic peptide
QRHVERAARAAVQALQL

SEQ ID NO: 8214 - protein, 17 aa, Artificial Sequence
  Description of Artificial Sequence: Synthetic peptide
VEDTVEALGKIRNAIAR

SEQ ID NO: 8215 - protein, 17 aa, Artificial Sequence
  Description of Artificial Sequence: Synthetic peptide
NEAADLVIKSMEKTIAS

SEQ ID NO: 8216 - protein, 17 aa, Artificial Sequence
  Description of Artificial Sequence: Synthetic peptide
ATDQKVEKMLISSIKEK

SEQ ID NO: 8217 - protein, 17 aa, Artificial Sequence
  Description of Artificial Sequence: Synthetic peptide
ADDTLALARARGEAMSA

SEQ ID NO: 8218 - protein, 17 aa, Artificial Sequence
  Description of Artificial Sequence: Synthetic peptide
REVSLTSGRLVLQGLRD

SEQ ID NO: 8219 - protein, 17 aa, Artificial Sequence
  Description of Artificial Sequence: Synthetic peptide
PDVREMNGVLKGMLSEW

SEQ ID NO: 8220 - protein, 17 aa, Artificial Sequence
  Description of Artificial Sequence: Synthetic peptide
VEEAVRIVKEVIQKLAN

SEQ ID NO: 8221 - protein, 17 aa, Artificial Sequence
  Description of Artificial Sequence: Synthetic peptide
LIKQAEAKKELEVFLDT

SEQ ID NO: 8222 - protein, 17 aa, Artificial Sequence
  Description of Artificial Sequence: Synthetic peptide
VNLIRERGQFIGEEVKA

SEQ ID NO: 8223 - protein, 17 aa, Artificial Sequence
  Description of Artificial Sequence: Synthetic peptide
LDESLKIVKEYLIAATA

SEQ ID NO: 8224 - protein, 17 aa, Artificial Sequence
  Description of Artificial Sequence: Synthetic peptide
AKVLAHGEKVLTSFGEG

SEQ ID NO: 8225 - protein, 17 aa, Artificial Sequence
  Description of Artificial Sequence: Synthetic peptide
RYERQKILLATAEALAA

SEQ ID NO: 8226 - protein, 17 aa, Artificial Sequence
  Description of Artificial Sequence: Synthetic peptide
PTISLKTVKLMKEGLEA

SEQ ID NO: 8227 - protein, 17 aa, Artificial Sequence
  Description of Artificial Sequence: Synthetic peptide
TKEKIAITENALAVAHQ

SEQ ID NO: 8228 - protein, 17 aa, Artificial Sequence
  Description of Artificial Sequence: Synthetic peptide
GVPASKTIAERDLKAMD

SEQ ID NO: 8229 - protein, 17 aa, Artificial Sequence
  Description of Artificial Sequence: Synthetic peptide
TYLKHDSVLKTIRGLVE

SEQ ID NO: 8230 - protein, 17 aa, Artificial Sequence
  Description of Artificial Sequence: Synthetic peptide
AEVAETKVAMVNKYARE

SEQ ID NO: 8231 - protein, 17 aa, Artificial Sequence
  Description of Artificial Sequence: Synthetic peptide
DALVRDAQQAAARIADS

SEQ ID NO: 8232 - protein, 17 aa, Artificial Sequence
  Description of Artificial Sequence: Synthetic peptide
DTMADSYGKVMGRDGRA

SEQ ID NO: 8233 - protein, 17 aa, Artificial Sequence
  Description of Artificial Sequence: Synthetic peptide
PGLVKETKRALNRALET

SEQ ID NO: 8234 - protein, 17 aa, Artificial Sequence
  Description of Artificial Sequence: Synthetic peptide
YLKEALRLAQEALNRLG

SEQ ID NO: 8235 - protein, 17 aa, Artificial Sequence
  Description of Artificial Sequence: Synthetic peptide
HSVWQRMGDELLAKAAE

SEQ ID NO: 8236 - protein, 17 aa, Artificial Sequence
  Description of Artificial Sequence: Synthetic peptide
ADEIKNVWKEEVSRLVG

SEQ ID NO: 8237 - protein, 17 aa, Artificial Sequence
  Description of Artificial Sequence: Synthetic peptide
EAAVTRSAERIVGQMEK

SEQ ID NO: 8238 - protein, 17 aa, Artificial Sequence
  Description of Artificial Sequence: Synthetic peptide
EAQRTALYTKAEQQLDK

SEQ ID NO: 8239 - protein, 17 aa, Artificial Sequence
  Description of Artificial Sequence: Synthetic peptide
LEDRAATLSKIIQVAVE

SEQ ID NO: 8240 - protein, 17 aa, Artificial Sequence
  Description of Artificial Sequence: Synthetic peptide
ETGIKEAKLGGERLKSR

SEQ ID NO: 8241 - protein, 17 aa, Artificial Sequence
  Description of Artificial Sequence: Synthetic peptide
QQQLDRAIEAFGQVGKK

SEQ ID NO: 8242 - protein, 17 aa, Artificial Sequence
  Description of Artificial Sequence: Synthetic peptide
PAAADATIAEAVKSARK

SEQ ID NO: 8243 - protein, 17 aa, Artificial Sequence
  Description of Artificial Sequence: Synthetic peptide
EENLKQARAALERLYTA

SEQ ID NO: 8244 - protein, 17 aa, Artificial Sequence
  Description of Artificial Sequence: Synthetic peptide
PEVTVEAIKRLSDLFAR

SEQ ID NO: 8245 - protein, 17 aa, Artificial Sequence
  Description of Artificial Sequence: Synthetic peptide
SHDARKEHKQFVAELKA

SEQ ID NO: 8246 - protein, 17 aa, Artificial Sequence
  Description of Artificial Sequence: Synthetic peptide
AAQRARVETEALKYLRA

SEQ ID NO: 8247 - protein, 17 aa, Artificial Sequence
  Description of Artificial Sequence: Synthetic peptide
PLTVKKHLRAQAIALEN

SEQ ID NO: 8248 - protein, 17 aa, Artificial Sequence
  Description of Artificial Sequence: Synthetic peptide
TDAVKKIAEAAFRVNEK

SEQ ID NO: 8249 - protein, 17 aa, Artificial Sequence
  Description of Artificial Sequence: Synthetic peptide
LENSKLNQKVIDAIYRA

SEQ ID NO: 8250 - protein, 17 aa, Artificial Sequence
  Description of Artificial Sequence: Synthetic peptide
LTELNSLISRLADDTKT

SEQ ID NO: 8251 - protein, 17 aa, Artificial Sequence
  Description of Artificial Sequence: Synthetic peptide
INDGLRIARKLLLDIND

SEQ ID NO: 8252 - protein, 17 aa, Artificial Sequence
  Description of Artificial Sequence: Synthetic peptide
NEASKALTSARFVLSDK

SEQ ID NO: 8253 - protein, 17 aa, Artificial Sequence
  Description of Artificial Sequence: Synthetic peptide
AVSERGAAEALTAIRRG

SEQ ID NO: 8254 - protein, 17 aa, Artificial Sequence
  Description of Artificial Sequence: Synthetic peptide
RTGVFIALDHLTQHIND

SEQ ID NO: 8255 - protein, 17 aa, Artificial Sequence
  Description of Artificial Sequence: Synthetic peptide
LHEKLFLLAIVRSLKIS

SEQ ID NO: 8256 - protein, 17 aa, Artificial Sequence
  Description of Artificial Sequence: Synthetic peptide
KDTSKKVQMARLAWEAS

SEQ ID NO: 8257 - protein, 17 aa, Artificial Sequence
  Description of Artificial Sequence: Synthetic peptide
GLQKEQAKLSLESWADV

SEQ ID NO: 8258 - protein, 17 aa, Artificial Sequence
  Description of Artificial Sequence: Synthetic peptide
LTKNLKVVKELISEAIQ

SEQ ID NO: 8259 - protein, 17 aa, Artificial Sequence
  Description of Artificial Sequence: Synthetic peptide
DATTAARAARLAAVAED

SEQ ID NO: 8260 - protein, 17 aa, Artificial Sequence
  Description of Artificial Sequence: Synthetic peptide
EAHAEKVHSYVTAGITS

SEQ ID NO: 8261 - protein, 18 aa, Artificial Sequence
  Description of Artificial Sequence: Synthetic peptide
QLVARLEGEVMLSALARK

SEQ ID NO: 8262 - protein, 18 aa, Artificial Sequence
  Description of Artificial Sequence: Synthetic peptide
TARVEEAQQAAVRIADTL

SEQ ID NO: 8263 - protein, 18 aa, Artificial Sequence
  Description of Artificial Sequence: Synthetic peptide
PRSVGKASEQLAGKVAEV

SEQ ID NO: 8264 - protein, 18 aa, Artificial Sequence
  Description of Artificial Sequence: Synthetic peptide
EADIHEGMQRFAQAVGKV

SEQ ID NO: 8265 - protein, 18 aa, Artificial Sequence
  Description of Artificial Sequence: Synthetic peptide
PKLVRAAVEAHSKALDSA

SEQ ID NO: 8266 - protein, 18 aa, Artificial Sequence
  Description of Artificial Sequence: Synthetic peptide
LETVRKATKSALEKAVEL

SEQ ID NO: 8267 - protein, 18 aa, Artificial Sequence
  Description of Artificial Sequence: Synthetic peptide
SLETVRKATKSALEKAVE

SEQ ID NO: 8268 - protein, 18 aa, Artificial Sequence
  Description of Artificial Sequence: Synthetic peptide
ERFNAALHESAHTVIAQV

SEQ ID NO: 8269 - protein, 18 aa, Artificial Sequence
  Description of Artificial Sequence: Synthetic peptide
SEVDIQGSMAYAKALEKA

SEQ ID NO: 8270 - protein, 18 aa, Artificial Sequence
  Description of Artificial Sequence: Synthetic peptide
RAAAAEIAVKTVSEFITR

SEQ ID NO: 8271 - protein, 18 aa, Artificial Sequence
  Description of Artificial Sequence: Synthetic peptide
IAAGQNELLKRAKANGDA

SEQ ID NO: 8272 - protein, 18 aa, Artificial Sequence
  Description of Artificial Sequence: Synthetic peptide
DAGRKNFAKTAVKLLQDL

SEQ ID NO: 8273 - protein, 18 aa, Artificial Sequence
  Description of Artificial Sequence: Synthetic peptide
EMAFKIAGSMAIKEAVQK

SEQ ID NO: 8274 - protein, 18 aa, Artificial Sequence
  Description of Artificial Sequence: Synthetic peptide
ARELAELGMKITAAANEQ

SEQ ID NO: 8275 - protein, 18 aa, Artificial Sequence
  Description of Artificial Sequence: Synthetic peptide
EKTMLVLALLLAKKVASH

SEQ ID NO: 8276 - protein, 18 aa, Artificial Sequence
  Description of Artificial Sequence: Synthetic peptide
ADAQKREVAAFLAQTSHE

SEQ ID NO: 8277 - protein, 18 aa, Artificial Sequence
  Description of Artificial Sequence: Synthetic peptide
IAHNLAQVRDKISAAATR

SEQ ID NO: 8278 - protein, 18 aa, Artificial Sequence
  Description of Artificial Sequence: Synthetic peptide
GDPIEINGLKAAFKELSN

SEQ ID NO: 8279 - protein, 18 aa, Artificial Sequence
  Description of Artificial Sequence: Synthetic peptide
LPGRIVQDQKNARAHAVT

SEQ ID NO: 8280 - protein, 18 aa, Artificial Sequence
  Description of Artificial Sequence: Synthetic peptide
EFDLLGQAAASKLARDLT

SEQ ID NO: 8281 - protein, 18 aa, Artificial Sequence
  Description of Artificial Sequence: Synthetic peptide
TDEGLKEATKLTQSVKKL

SEQ ID NO: 8282 - protein, 18 aa, Artificial Sequence
  Description of Artificial Sequence: Synthetic peptide
DAELAQSISMTRAEAKAA

SEQ ID NO: 8283 - protein, 18 aa, Artificial Sequence
  Description of Artificial Sequence: Synthetic peptide
GSAFESAMVNHVTKVADH

SEQ ID NO: 8284 - protein, 18 aa, Artificial Sequence
  Description of Artificial Sequence: Synthetic peptide
AKVKAHGKKVIDSFSEGL

SEQ ID NO: 8285 - protein, 18 aa, Artificial Sequence
  Description of Artificial Sequence: Synthetic peptide
SKESGIIQGDLIAKHWAA

SEQ ID NO: 8286 - protein, 18 aa, Artificial Sequence
  Description of Artificial Sequence: Synthetic peptide
AEQAQQVHAFLRGRLAAK

SEQ ID NO: 8287 - protein, 18 aa, Artificial Sequence
  Description of Artificial Sequence: Synthetic peptide
ADLKGQLAQRIVDDVSVA

SEQ ID NO: 8288 - protein, 18 aa, Artificial Sequence
  Description of Artificial Sequence: Synthetic peptide
SESLVKTLISEFAAVAEK

SEQ ID NO: 8289 - protein, 18 aa, Artificial Sequence
  Description of Artificial Sequence: Synthetic peptide
FRQAHTASGKAVHLAETK

SEQ ID NO: 8290 - protein, 18 aa, Artificial Sequence
  Description of Artificial Sequence: Synthetic peptide
IQSKVALKTFAAADQREA

SEQ ID NO: 8291 - protein, 18 aa, Artificial Sequence
  Description of Artificial Sequence: Synthetic peptide
DNVMTAEMRKIAMAAVLD

SEQ ID NO: 8292 - protein, 18 aa, Artificial Sequence
  Description of Artificial Sequence: Synthetic peptide
ISYIIRKADSVNKALDSA

SEQ ID NO: 8293 - protein, 18 aa, Artificial Sequence
  Description of Artificial Sequence: Synthetic peptide
VSKMLASFEKIITETVAK

SEQ ID NO: 8294 - protein, 18 aa, Artificial Sequence
  Description of Artificial Sequence: Synthetic peptide
AAEVNTRVAKVVQDAANK

SEQ ID NO: 8295 - protein, 18 aa, Artificial Sequence
  Description of Artificial Sequence: Synthetic peptide
NKEQAKAREAIGNGLTML

SEQ ID NO: 8296 - protein, 18 aa, Artificial Sequence
  Description of Artificial Sequence: Synthetic peptide
PMIAKHGTTILHGLDRAV

SEQ ID NO: 8297 - protein, 18 aa, Artificial Sequence
  Description of Artificial Sequence: Synthetic peptide
EKILNDVSQAKAQHLKAA

SEQ ID NO: 8298 - protein, 18 aa, Artificial Sequence
  Description of Artificial Sequence: Synthetic peptide
VVAEVKAFLEAQARRALS

SEQ ID NO: 8299 - protein, 18 aa, Artificial Sequence
  Description of Artificial Sequence: Synthetic peptide
PIAIAEVREALTRTLATE

SEQ ID NO: 8300 - protein, 18 aa, Artificial Sequence
  Description of Artificial Sequence: Synthetic peptide
AGAATEEFIKRAEVNGLA

SEQ ID NO: 8301 - protein, 18 aa, Artificial Sequence
  Description of Artificial Sequence: Synthetic peptide
AKDAGLFIGSIVQEIAER

SEQ ID NO: 8302 - protein, 18 aa, Artificial Sequence
  Description of Artificial Sequence: Synthetic peptide
YDIAMEIVNGVDRVIKAS

SEQ ID NO: 8303 - protein, 18 aa, Artificial Sequence
  Description of Artificial Sequence: Synthetic peptide
DAATIKALLSHAHEAQRS

SEQ ID NO: 8304 - protein, 18 aa, Artificial Sequence
  Description of Artificial Sequence: Synthetic peptide
KNEQLAIAHGIQKIIAEN

SEQ ID NO: 8305 - protein, 18 aa, Artificial Sequence
  Description of Artificial Sequence: Synthetic peptide
LAAQKTLVDGIRKEVAAE

SEQ ID NO: 8306 - protein, 18 aa, Artificial Sequence
  Description of Artificial Sequence: Synthetic peptide
KAAFLKATDELIAAVTAH

SEQ ID NO: 8307 - protein, 18 aa, Artificial Sequence
  Description of Artificial Sequence: Synthetic peptide
AEARGNRMADQAAREAAM

SEQ ID NO: 8308 - protein, 18 aa, Artificial Sequence
  Description of Artificial Sequence: Synthetic peptide
GAQALKAVLEHGPTLRQR

SEQ ID NO: 8309 - protein, 18 aa, Artificial Sequence
  Description of Artificial Sequence: Synthetic peptide
KVGNIIDTMITDAFLKAD

SEQ ID NO: 8310 - protein, 18 aa, Artificial Sequence
  Description of Artificial Sequence: Synthetic peptide
GGAKASDDARTLAEVFTK

SEQ ID NO: 8311 - protein, 18 aa, Artificial Sequence
  Description of Artificial Sequence: Synthetic peptide
RAKASFDTRVAAAELALA

SEQ ID NO: 8312 - protein, 18 aa, Artificial Sequence
  Description of Artificial Sequence: Synthetic peptide
TDQLLEHAKESLTHAKAA

SEQ ID NO: 8313 - protein, 18 aa, Artificial Sequence
  Description of Artificial Sequence: Synthetic peptide
RAEVDLVVQDLKQAVAQL

SEQ ID NO: 8314 - protein, 18 aa, Artificial Sequence
  Description of Artificial Sequence: Synthetic peptide
GADLENLLNEAALLAARK

SEQ ID NO: 8315 - protein, 18 aa, Artificial Sequence
  Description of Artificial Sequence: Synthetic peptide
ADVRKNANEAVLGIMIHL

SEQ ID NO: 8316 - protein, 18 aa, Artificial Sequence
  Description of Artificial Sequence: Synthetic peptide
IAAAIETTRTVLAAARER

SEQ ID NO: 8317 - protein, 18 aa, Artificial Sequence
  Description of Artificial Sequence: Synthetic peptide
VEADVTIGPYLKAQADKQ

SEQ ID NO: 8318 - protein, 18 aa, Artificial Sequence
  Description of Artificial Sequence: Synthetic peptide
TKQILDAKGPEGVVDWVK

SEQ ID NO: 8319 - protein, 18 aa, Artificial Sequence
  Description of Artificial Sequence: Synthetic peptide
GAQALKAVLEHGPTLNER

SEQ ID NO: 8320 - protein, 18 aa, Artificial Sequence
  Description of Artificial Sequence: Synthetic peptide
RPEAEAVSMLVKEAVVTF

SEQ ID NO: 8321 - protein, 18 aa, Artificial Sequence
  Description of Artificial Sequence: Synthetic peptide
IADKAEQVIQNIKNVLEA

SEQ ID NO: 8322 - protein, 18 aa, Artificial Sequence
  Description of Artificial Sequence: Synthetic peptide
PMVRAHGKKVLTSFGDAV

SEQ ID NO: 8323 - protein, 18 aa, Artificial Sequence
  Description of Artificial Sequence: Synthetic peptide
SNKEALAKGMLLLFAHHL

SEQ ID NO: 8324 - protein, 18 aa, Artificial Sequence
  Description of Artificial Sequence: Synthetic peptide
PLEAVRMQNLIAREAEAA

SEQ ID NO: 8325 - protein, 18 aa, Artificial Sequence
  Description of Artificial Sequence: Synthetic peptide
ATGDLALKKLENAIKKVQ

SEQ ID NO: 8326 - protein, 18 aa, Artificial Sequence
  Description of Artificial Sequence: Synthetic peptide
VETRKVMADLVVGNLEAH

SEQ ID NO: 8327 - protein, 18 aa, Artificial Sequence
  Description of Artificial Sequence: Synthetic peptide
AQTRDGIIAGFKKALDET

SEQ ID NO: 8328 - protein, 18 aa, Artificial Sequence
  Description of Artificial Sequence: Synthetic peptide
KDLASALELLTGLRKKIA

SEQ ID NO: 8329 - protein, 18 aa, Artificial Sequence
  Description of Artificial Sequence: Synthetic peptide
RAQAQKLAGTAHDGLARA

SEQ ID NO: 8330 - protein, 18 aa, Artificial Sequence
  Description of Artificial Sequence: Synthetic peptide
PTLVKRQATTIAKELAEL

SEQ ID NO: 8331 - protein, 18 aa, Artificial Sequence
  Description of Artificial Sequence: Synthetic peptide
VEKNLKIFKGIVSEVMAS

SEQ ID NO: 8332 - protein, 18 aa, Artificial Sequence
  Description of Artificial Sequence: Synthetic peptide
ENAANTVAHARKAIHKIL

SEQ ID NO: 8333 - protein, 18 aa, Artificial Sequence
  Description of Artificial Sequence: Synthetic peptide
EDLKKVGNRVLTALGGIL

SEQ ID NO: 8334 - protein, 18 aa, Artificial Sequence
  Description of Artificial Sequence: Synthetic peptide
EDLKKHGVTFLTALGAIL

SEQ ID NO: 8335 - protein, 18 aa, Artificial Sequence
  Description of Artificial Sequence: Synthetic peptide
EDLKKHGVTALTALGAIL

SEQ ID NO: 8336 - protein, 18 aa, Artificial Sequence
  Description of Artificial Sequence: Synthetic peptide
VQDIKNNLKEAIETIVAA

SEQ ID NO: 8337 - protein, 18 aa, Artificial Sequence
  Description of Artificial Sequence: Synthetic peptide
GESRVISVAEVKGLVEQW

SEQ ID NO: 8338 - protein, 18 aa, Artificial Sequence
  Description of Artificial Sequence: Synthetic peptide
AAQVKDALTKMRAAALDA

SEQ ID NO: 8339 - protein, 18 aa, Artificial Sequence
  Description of Artificial Sequence: Synthetic peptide
EDLKKHGATVLTALGGIL

SEQ ID NO: 8340 - protein, 18 aa, Artificial Sequence
  Description of Artificial Sequence: Synthetic peptide
QVKGHGKKVADALTNAVA

SEQ ID NO: 8341 - protein, 18 aa, Artificial Sequence
  Description of Artificial Sequence: Synthetic peptide
VVDRFLADLQDAVAQVRA

SEQ ID NO: 8342 - protein, 18 aa, Artificial Sequence
  Description of Artificial Sequence: Synthetic peptide
EDLKKDGVTSLTALGAIL

SEQ ID NO: 8343 - protein, 18 aa, Artificial Sequence
  Description of Artificial Sequence: Synthetic peptide
ADEQRSVRALVTATTAVD

SEQ ID NO: 8344 - protein, 18 aa, Artificial Sequence
  Description of Artificial Sequence: Synthetic peptide
EEVKKHGTTVLTALGRIL

SEQ ID NO: 8345 - protein, 18 aa, Artificial Sequence
  Description of Artificial Sequence: Synthetic peptide
VDEGVDLVIRAISAAKQR

SEQ ID NO: 8346 - protein, 18 aa, Artificial Sequence
  Description of Artificial Sequence: Synthetic peptide
AESIAKAQKSREIFEGIA

SEQ ID NO: 8347 - protein, 18 aa, Artificial Sequence
  Description of Artificial Sequence: Synthetic peptide
EDLKKHGVTVLTALGAIL

SEQ ID NO: 8348 - protein, 18 aa, Artificial Sequence
  Description of Artificial Sequence: Synthetic peptide
RDALIENYKTSIRNVGAA

SEQ ID NO: 8349 - protein, 18 aa, Artificial Sequence
  Description of Artificial Sequence: Synthetic peptide
TEELAVDALYNAIKVRLA

SEQ ID NO: 8350 - protein, 18 aa, Artificial Sequence
  Description of Artificial Sequence: Synthetic peptide
PGTGEIVAEAVDAAIRKT

SEQ ID NO: 8351 - protein, 18 aa, Artificial Sequence
  Description of Artificial Sequence: Synthetic peptide
PETAADKLLAAINERRAG

SEQ ID NO: 8352 - protein, 18 aa, Artificial Sequence
  Description of Artificial Sequence: Synthetic peptide
LGASGARILTTLVHEMRR

SEQ ID NO: 8353 - protein, 18 aa, Artificial Sequence
  Description of Artificial Sequence: Synthetic peptide
EDLKKHGVTVLTGLGAIL

SEQ ID NO: 8354 - protein, 18 aa, Artificial Sequence
  Description of Artificial Sequence: Synthetic peptide
YEGELNKVTSNVAIGRSH

SEQ ID NO: 8355 - protein, 18 aa, Artificial Sequence
  Description of Artificial Sequence: Synthetic peptide
GATLTGTVQDIIRELARH

SEQ ID NO: 8356 - protein, 18 aa, Artificial Sequence
  Description of Artificial Sequence: Synthetic peptide
RAKASFDTRVAAAELALN

SEQ ID NO: 8357 - protein, 18 aa, Artificial Sequence
  Description of Artificial Sequence: Synthetic peptide
GPEVMDAAIRVLKTVLDN

SEQ ID NO: 8358 - protein, 18 aa, Artificial Sequence
  Description of Artificial Sequence: Synthetic peptide
RSEADDLATRVANAVRDA

SEQ ID NO: 8359 - protein, 18 aa, Artificial Sequence
  Description of Artificial Sequence: Synthetic peptide
GATQNLPKLAEFIRIAKE

SEQ ID NO: 8360 - protein, 18 aa, Artificial Sequence
  Description of Artificial Sequence: Synthetic peptide
VDGAVRMGQRTAADIIAR

SEQ ID NO: 8361 - protein, 18 aa, Artificial Sequence
  Description of Artificial Sequence: Synthetic peptide
HAQITETAGAVKRAMRDA

SEQ ID NO: 8362 - protein, 18 aa, Artificial Sequence
  Description of Artificial Sequence: Synthetic peptide
AKELVDRSVSLSKAVKAI

SEQ ID NO: 8363 - protein, 18 aa, Artificial Sequence
  Description of Artificial Sequence: Synthetic peptide
EDLKKHGNTVLTALGGIL

SEQ ID NO: 8364 - protein, 18 aa, Artificial Sequence
  Description of Artificial Sequence: Synthetic peptide
PEALLKRADEGVYQAKAS

SEQ ID NO: 8365 - protein, 18 aa, Artificial Sequence
  Description of Artificial Sequence: Synthetic peptide
EVYQILEKGAAKRTTAAT

SEQ ID NO: 8366 - protein, 18 aa, Artificial Sequence
  Description of Artificial Sequence: Synthetic peptide
LDEVNKKAFQGTLLAHVD

SEQ ID NO: 8367 - protein, 18 aa, Artificial Sequence
  Description of Artificial Sequence: Synthetic peptide
GDKKAALVSYIGETRQQL

SEQ ID NO: 8368 - protein, 18 aa, Artificial Sequence
  Description of Artificial Sequence: Synthetic peptide
EDLKKHGTVVLTALGGIL

SEQ ID NO: 8369 - protein, 18 aa, Artificial Sequence
  Description of Artificial Sequence: Synthetic peptide
KESLVMAGDLVIKTAKKH

SEQ ID NO: 8370 - protein, 18 aa, Artificial Sequence
  Description of Artificial Sequence: Synthetic peptide
NTYVKGANAALEKIEKHL

SEQ ID NO: 8371 - protein, 18 aa, Artificial Sequence
  Description of Artificial Sequence: Synthetic peptide
ESEKVNEIVKAVKTALTG

SEQ ID NO: 8372 - protein, 18 aa, Artificial Sequence
  Description of Artificial Sequence: Synthetic peptide
GAQALHTVLDLEPALGKR

SEQ ID NO: 8373 - protein, 18 aa, Artificial Sequence
  Description of Artificial Sequence: Synthetic peptide
DEDKAVDLIVFKKAVLST

SEQ ID NO: 8374 - protein, 18 aa, Artificial Sequence
  Description of Artificial Sequence: Synthetic peptide
VGATGGRMLATLARELHR

SEQ ID NO: 8375 - protein, 18 aa, Artificial Sequence
  Description of Artificial Sequence: Synthetic peptide
SEVDIQASIAYAKALEKA

SEQ ID NO: 8376 - protein, 18 aa, Artificial Sequence
  Description of Artificial Sequence: Synthetic peptide
TDTAILLKDALAAAHARY

SEQ ID NO: 8377 - protein, 18 aa, Artificial Sequence
  Description of Artificial Sequence: Synthetic peptide
RDLLETAGKLMAKESIAK

SEQ ID NO: 8378 - protein, 19 aa, Artificial Sequence
  Description of Artificial Sequence: Synthetic peptide
EDLKKQGVTVLTALGAILK

SEQ ID NO: 8379 - protein, 19 aa, Artificial Sequence
  Description of Artificial Sequence: Synthetic peptide
AAQVKDALTKMRAAALDAQ

SEQ ID NO: 8380 - protein, 19 aa, Artificial Sequence
  Description of Artificial Sequence: Synthetic peptide
TKAGVLADALDKATEKLLN

SEQ ID NO: 8381 - protein, 19 aa, Artificial Sequence
  Description of Artificial Sequence: Synthetic peptide
EDLKKDGVTALTALGAILK

SEQ ID NO: 8382 - protein, 19 aa, Artificial Sequence
  Description of Artificial Sequence: Synthetic peptide
EDLKEHGTVVLTALGGILK

SEQ ID NO: 8383 - protein, 19 aa, Artificial Sequence
  Description of Artificial Sequence: Synthetic peptide
EDLKKVGNTTLTALGGILK

SEQ ID NO: 8384 - protein, 19 aa, Artificial Sequence
  Description of Artificial Sequence: Synthetic peptide
DAELNSLAKGAVKELASLY

SEQ ID NO: 8385 - protein, 19 aa, Artificial Sequence
  Description of Artificial Sequence: Synthetic peptide
NSAIGYEEAAKVAKQALAE

SEQ ID NO: 8386 - protein, 19 aa, Artificial Sequence
  Description of Artificial Sequence: Synthetic peptide
TGPAIDHAADLLLSHARNV

SEQ ID NO: 8387 - protein, 19 aa, Artificial Sequence
  Description of Artificial Sequence: Synthetic peptide
AEELDKVARLAAKALASVS

SEQ ID NO: 8388 - protein, 19 aa, Artificial Sequence
  Description of Artificial Sequence: Synthetic peptide
GELAKHAVSEGTKAVTKYT

SEQ ID NO: 8389 - protein, 19 aa, Artificial Sequence
  Description of Artificial Sequence: Synthetic peptide
DADLAAAVESAKAAQPKWA

SEQ ID NO: 8390 - protein, 19 aa, Artificial Sequence
  Description of Artificial Sequence: Synthetic peptide
EKAKVLAKALDTATGKLLE

SEQ ID NO: 8391 - protein, 19 aa, Artificial Sequence
  Description of Artificial Sequence: Synthetic peptide
DAEQAQELARIAKAATFAA

SEQ ID NO: 8392 - protein, 19 aa, Artificial Sequence
  Description of Artificial Sequence: Synthetic peptide
IDSTIKSGLTAARDVNRAS

SEQ ID NO: 8393 - protein, 19 aa, Artificial Sequence
  Description of Artificial Sequence: Synthetic peptide
EDLKKHGVTVLTGLGAILK

SEQ ID NO: 8394 - protein, 19 aa, Artificial Sequence
  Description of Artificial Sequence: Synthetic peptide
GGGTDLGKFVLAKKEENAK

SEQ ID NO: 8395 - protein, 19 aa, Artificial Sequence
  Description of Artificial Sequence: Synthetic peptide
PSVGSLAEKVDAERIAIAK

SEQ ID NO: 8396 - protein, 19 aa, Artificial Sequence
  Description of Artificial Sequence: Synthetic peptide
EDLKKLGVTVLTALGAILK

SEQ ID NO: 8397 - protein, 19 aa, Artificial Sequence
  Description of Artificial Sequence: Synthetic peptide
AQVKGHGKKVADALTNAVA

SEQ ID NO: 8398 - protein, 19 aa, Artificial Sequence
  Description of Artificial Sequence: Synthetic peptide
KLLSAAKILADATAKMVEA

SEQ ID NO: 8399 - protein, 5 aa, Artificial Sequence
  Description of Artificial Sequence: Synthetic peptide
GGGGS

SEQ ID NO: 8400 - protein, 17 aa, Artificial Sequence
  Description of Artificial Sequence: Synthetic peptide
YYCARTVGAAAFDIWGQ

SEQ ID NO: 8401 - protein, 18 aa, Artificial Sequence
  Description of Artificial Sequence: Synthetic peptide
YYCGTLDSILRSWVFGQG

SEQ ID NO: 8402 - protein, 18 aa, Artificial Sequence
  Description of Artificial Sequence: Synthetic peptide
YYCARSGNSYGQFDYWGQ

SEQ ID NO: 8403 - protein, 16 aa, Artificial Sequence
  Description of Artificial Sequence: Synthetic peptide
YYCQTWGTGHVVFGQG

SEQ ID NO: 8404 - protein, 17 aa, Artificial Sequence
  Description of Artificial Sequence: Synthetic peptide
YYCATYDVLTGFEYWGQ

SEQ ID NO: 8405 - protein, 16 aa, Artificial Sequence
  Description of Artificial Sequence: Synthetic peptide
YYCQTWGTGIRVFGQG

SEQ ID NO: 8406 - protein, 19 aa, Artificial Sequence
  Description of Artificial Sequence: Synthetic peptide
YYCARDRGYSGYGLRYWGQ

SEQ ID NO: 8407 - protein, 16 aa, Artificial Sequence
  Description of Artificial Sequence: Synthetic peptide
YYCQSYDHNSVVFGQG

SEQ ID NO: 8408 - protein, 17 aa, Artificial Sequence
  Description of Artificial Sequence: Synthetic peptide
YYCSGGELARGFDPWGQ

SEQ ID NO: 8409 - protein, 16 aa, Artificial Sequence
  Description of Artificial Sequence: Synthetic peptide
YYCQQSVTIPRTFGQG

SEQ ID NO: 8410 - protein, 16 aa, Artificial Sequence
  Description of Artificial Sequence: Synthetic peptide
YYCARDWWGAFDVWGQ

SEQ ID NO: 8411 - protein, 16 aa, Artificial Sequence
  Description of Artificial Sequence: Synthetic peptide
YYCQQFNSLGWIFGQG

SEQ ID NO: 8412 - protein, 20 aa, Artificial Sequence
  Description of Artificial Sequence: Synthetic peptide
YYCARGGSVDIAYGFDYWGQ

SEQ ID NO: 8413 - protein, 16 aa, Artificial Sequence
  Description of Artificial Sequence: Synthetic peptide
YYCQQANSFPLTFGQG

SEQ ID NO: 8414 - protein, 20 aa, Artificial Sequence
  Description of Artificial Sequence: Synthetic peptide
YYCARTVGPYGRTYFDYWGQ

SEQ ID NO: 8415 - protein, 16 aa, Artificial Sequence
  Description of Artificial Sequence: Synthetic peptide
YYCQQAISFPLTFGQG

SEQ ID NO: 8416 - protein, 16 aa, Artificial Sequence
  Description of Artificial Sequence: Synthetic peptide
YYCQQANSFPITFGQG

SEQ ID NO: 8417 - protein, 16 aa, Artificial Sequence
  Description of Artificial Sequence: Synthetic peptide
YYCQQANSFPPTFGQG

SEQ ID NO: 8418 - protein, 16 aa, Artificial Sequence
  Description of Artificial Sequence: Synthetic peptide
YYCQQAYSFPPTFGQG

SEQ ID NO: 8419 - protein, 16 aa, Artificial Sequence
  Description of Artificial Sequence: Synthetic peptide
YYCQQGINWPLTFGQG

SEQ ID NO: 8420 - protein, 15 aa, Artificial Sequence
  Description of Artificial Sequence: Synthetic peptide
YYCQTWGSGIVFGQG

SEQ ID NO: 8421 - protein, 17 aa, Artificial Sequence
  Description of Artificial Sequence: Synthetic peptide
YYCARARGANTWDYWGQ

SEQ ID NO: 8422 - protein, 16 aa, Artificial Sequence
  Description of Artificial Sequence: Synthetic peptide
YYCQQEYSFPVTFGQG

SEQ ID NO: 8423 - protein, 19 aa, Artificial Sequence
  Description of Artificial Sequence: Synthetic peptide
YYCARGPGYSYAAMDVWGQ

SEQ ID NO: 8424 - protein, 16 aa, Artificial Sequence
  Description of Artificial Sequence: Synthetic peptide
YYCQQDYSFPPTFGQG

SEQ ID NO: 8425 - protein, 18 aa, Artificial Sequence
  Description of Artificial Sequence: Synthetic peptide
YYCARSGQYGGYFDYWGQ

SEQ ID NO: 8426 - protein, 16 aa, Artificial Sequence
  Description of Artificial Sequence: Synthetic peptide
YYCARTAAYVLGHWGQ

SEQ ID NO: 8427 - protein, 16 aa, Artificial Sequence
  Description of Artificial Sequence: Synthetic peptide
YYCQQSYSIPFTFGQG

SEQ ID NO: 8428 - protein, 16 aa, Artificial Sequence
  Description of Artificial Sequence: Synthetic peptide
YYCQQSYSIPLTFGQG

SEQ ID NO: 8429 - protein, 20 aa, Artificial Sequence
  Description of Artificial Sequence: Synthetic peptide
YYCAKNDILAYGSAFDYWGQ

SEQ ID NO: 8430 - protein, 18 aa, Artificial Sequence
  Description of Artificial Sequence: Synthetic peptide
YYCQVWDSSSDHWVFGQG

SEQ ID NO: 8431 - protein, 20 aa, Artificial Sequence
  Description of Artificial Sequence: Synthetic peptide
YYCAKNDILAYGSASDYWGQ

SEQ ID NO: 8432 - protein, 20 aa, Artificial Sequence
  Description of Artificial Sequence: Synthetic peptide
YYCAKNDILTYGSAFDYWGQ

SEQ ID NO: 8433 - protein, 18 aa, Artificial Sequence
  Description of Artificial Sequence: Synthetic peptide
YYCQVWDGGSDHWVFGQG

SEQ ID NO: 8434 - protein, 18 aa, Artificial Sequence
  Description of Artificial Sequence: Synthetic peptide
YYCQVWDNGSDHWVFGQG

SEQ ID NO: 8435 - protein, 18 aa, Artificial Sequence
  Description of Artificial Sequence: Synthetic peptide
YYCQVWDSISDHWVFGQG

SEQ ID NO: 8436 - protein, 18 aa, Artificial Sequence
  Description of Artificial Sequence: Synthetic peptide
YYCQVWDTNTDHWLFGQG

SEQ ID NO: 8437 - protein, 16 aa, Artificial Sequence
  Description of Artificial Sequence: Synthetic peptide
YYCAKNRYSYGDYWGQ

SEQ ID NO: 8438 - protein, 17 aa, Artificial Sequence
  Description of Artificial Sequence: Synthetic peptide
YYCAAWDDLSGWVFGQG

SEQ ID NO: 8439 - protein, 19 aa, Artificial Sequence
  Description of Artificial Sequence: Synthetic peptide
YYCARGPRFGELPFDYWGQ

SEQ ID NO: 8440 - protein, 17 aa, Artificial Sequence
  Description of Artificial Sequence: Synthetic peptide
YYCQQSYSNTTWLFGQG

SEQ ID NO: 8441 - protein, 20 aa, Artificial Sequence
  Description of Artificial Sequence: Synthetic peptide
YYCARQGWLATTRGMDLWGQ

SEQ ID NO: 8442 - protein, 16 aa, Artificial Sequence
  Description of Artificial Sequence: Synthetic peptide
YYCQAGDRTTGQFGQG

SEQ ID NO: 8443 - protein, 20 aa, Artificial Sequence
  Description of Artificial Sequence: Synthetic peptide
YYCARANVYQQTWAFDPWGQ

SEQ ID NO: 8444 - protein, 16 aa, Artificial Sequence
  Description of Artificial Sequence: Synthetic peptide
YYCMQGERWPLAFGQG

SEQ ID NO: 8445 - protein, 22 aa, Artificial Sequence
  Description of Artificial Sequence: Synthetic peptide
YYCARFGVGYDTHYMYFDHWGQ

SEQ ID NO: 8446 - protein, 16 aa, Artificial Sequence
  Description of Artificial Sequence: Synthetic peptide
YYCQQFHSFPLTFGQG

SEQ ID NO: 8447 - protein, 17 aa, Artificial Sequence
  Description of Artificial Sequence: Synthetic peptide
YYCARMSRYGAFDLWGQ

SEQ ID NO: 8448 - protein, 16 aa, Artificial Sequence
  Description of Artificial Sequence: Synthetic peptide
YYCQQYNNWPLTFGQG

SEQ ID NO: 8449 - protein, 19 aa, Artificial Sequence
  Description of Artificial Sequence: Synthetic peptide
YYCARPLPNVGYGMDVWGQ

SEQ ID NO: 8450 - protein, 19 aa, Artificial Sequence
  Description of Artificial Sequence: Synthetic peptide
YYCGTWDSSLLLSYVFGQG

SEQ ID NO: 8451 - protein, 19 aa, Artificial Sequence
  Description of Artificial Sequence: Synthetic peptide
YYCARTRIGYSHHADYWGQ

SEQ ID NO: 8452 - protein, 17 aa, Artificial Sequence
  Description of Artificial Sequence: Synthetic peptide
YYCYSYVGSSTWVFGQG

SEQ ID NO: 8453 - protein, 24 aa, Artificial Sequence
  Description of Artificial Sequence: Synthetic peptide
YYCARWNIAIVGAAPVPVMDVWGQ

SEQ ID NO: 8454 - protein, 16 aa, Artificial Sequence
  Description of Artificial Sequence: Synthetic peptide
YYCQQANSFPVSFGQG

SEQ ID NO: 8455 - protein, 16 aa, Artificial Sequence
  Description of Artificial Sequence: Synthetic peptide
YYCQQANSFPVTFGQG

SEQ ID NO: 8456 - protein, 23 aa, Artificial Sequence
  Description of Artificial Sequence: Synthetic peptide
YYCAKDRGGDVVTAGRGFDYWGQ

SEQ ID NO: 8457 - protein, 17 aa, Artificial Sequence
  Description of Artificial Sequence: Synthetic peptide
YYCQQYNNWPPITFGQG

SEQ ID NO: 8458 - protein, 17 aa, Artificial Sequence
  Description of Artificial Sequence: Synthetic peptide
YYCANGRSSAYFNHWGQ

SEQ ID NO: 8459 - protein, 16 aa, Artificial Sequence
  Description of Artificial Sequence: Synthetic peptide
YYCQQANSFPYTFGQG

SEQ ID NO: 8460 - protein, 18 aa, Artificial Sequence
  Description of Artificial Sequence: Synthetic peptide
YYCARYGSNYRYFDRWGQ

SEQ ID NO: 8461 - protein, 16 aa, Artificial Sequence
  Description of Artificial Sequence: Synthetic peptide
YYCMQGSHWPWAFGQG

SEQ ID NO: 8462 - protein, 18 aa, Artificial Sequence
  Description of Artificial Sequence: Synthetic peptide
YYCASPKYGDFYFDYWGQ

SEQ ID NO: 8463 - protein, 16 aa, Artificial Sequence
  Description of Artificial Sequence: Synthetic peptide
YYCQQHYAIPLTFGQG

SEQ ID NO: 8464 - protein, 19 aa, Artificial Sequence
  Description of Artificial Sequence: Synthetic peptide
YYCARGLIMTPGYLDYWGQ

SEQ ID NO: 8465 - protein, 16 aa, Artificial Sequence
  Description of Artificial Sequence: Synthetic peptide
YYCQTWGTGGLVFGQG

SEQ ID NO: 8466 - protein, 24 aa, Artificial Sequence
  Description of Artificial Sequence: Synthetic peptide
YYCARMRWGIYRGKLSVYMDVWGQ

SEQ ID NO: 8467 - protein, 17 aa, Artificial Sequence
  Description of Artificial Sequence: Synthetic peptide
YYCQSYDSSLSGVFGQG

SEQ ID NO: 8468 - protein, 14 aa, Artificial Sequence
  Description of Artificial Sequence: Synthetic peptide
YYCATNDWWGHWGQ

SEQ ID NO: 8469 - protein, 18 aa, Artificial Sequence
  Description of Artificial Sequence: Synthetic peptide
YYCQVWDSQSNSWVFGQG

SEQ ID NO: 8470 - protein, 17 aa, Artificial Sequence
  Description of Artificial Sequence: Synthetic peptide
YYCARDTGFGSFDYWGQ

SEQ ID NO: 8471 - protein, 17 aa, Artificial Sequence
  Description of Artificial Sequence: Synthetic peptide
YYCSSYTSSSTWGFGQG

SEQ ID NO: 8472 - protein, 27 aa, Artificial Sequence
  Description of Artificial Sequence: Synthetic peptide
YYCARERGGDYGSGYYLPNYGMDVWGQ

SEQ ID NO: 8473 - protein, 17 aa, Artificial Sequence
  Description of Artificial Sequence: Synthetic peptide
YYCQQYDTTPPLTFGQG

SEQ ID NO: 8474 - protein, 19 aa, Artificial Sequence
  Description of Artificial Sequence: Synthetic peptide
YYCAREWGGSWFGMDPWGQ

SEQ ID NO: 8475 - protein, 16 aa, Artificial Sequence
  Description of Artificial Sequence: Synthetic peptide
YYCQQYNSSSITFGQG

SEQ ID NO: 8476 - protein, 16 aa, Artificial Sequence
  Description of Artificial Sequence: Synthetic peptide
YYCQSYDSSNAVFGQG

SEQ ID NO: 8477 - protein, 19 aa, Artificial Sequence
  Description of Artificial Sequence: Synthetic peptide
YYCATYLGGIVGASDYWGQ

SEQ ID NO: 8478 - protein, 16 aa, Artificial Sequence
  Description of Artificial Sequence: Synthetic peptide
YYCQQEYTAPVTFGQG

SEQ ID NO: 8479 - protein, 14 aa, Artificial Sequence
  Description of Artificial Sequence: Synthetic peptide
YYCAAGSTYDVWGQ

SEQ ID NO: 8480 - protein, 15 aa, Artificial Sequence
  Description of Artificial Sequence: Synthetic peptide
YYCQVWDNNVVFGQG

SEQ ID NO: 8481 - protein, 17 aa, Artificial Sequence
  Description of Artificial Sequence: Synthetic peptide
YYCQVWDSSSGVVFGQG

SEQ ID NO: 8482 - protein, 23 aa, Artificial Sequence
  Description of Artificial Sequence: Synthetic peptide
YYCARGRYRNLSYDDDDFDIWGQ

SEQ ID NO: 8483 - protein, 17 aa, Artificial Sequence
  Description of Artificial Sequence: Synthetic peptide
YYCQAWDSSTGVVFGQG

SEQ ID NO: 8484 - protein, 17 aa, Artificial Sequence
  Description of Artificial Sequence: Synthetic peptide
YYCASAGPDDDFDYWGQ

SEQ ID NO: 8485 - protein, 15 aa, Artificial Sequence
  Description of Artificial Sequence: Synthetic peptide
YYCQVWDSSTVFGQG

SEQ ID NO: 8486 - protein, 16 aa, Artificial Sequence
  Description of Artificial Sequence: Synthetic peptide
YYCARDVQYRFDPWGQ

SEQ ID NO: 8487 - protein, 16 aa, Artificial Sequence
  Description of Artificial Sequence: Synthetic peptide
YYCGQNKQFPWTFGQG

SEQ ID NO: 8488 - protein, 15 aa, Artificial Sequence
  Description of Artificial Sequence: Synthetic peptide
YYCAREYYGIDVWGQ

SEQ ID NO: 8489 - protein, 20 aa, Artificial Sequence
  Description of Artificial Sequence: Synthetic peptide
YYCQSYDSSLSSPNVVFGQG

SEQ ID NO: 8490 - protein, 19 aa, Artificial Sequence
  Description of Artificial Sequence: Synthetic peptide
YYCAGAGSSAASGFATWGQ

SEQ ID NO: 8491 - protein, 16 aa, Artificial Sequence
  Description of Artificial Sequence: Synthetic peptide
YYCQTWGAASGVFGQG

SEQ ID NO: 8492 - protein, 17 aa, Artificial Sequence
  Description of Artificial Sequence: Synthetic peptide
YYCARDTSSGAMDIWGQ

SEQ ID NO: 8493 - protein, 17 aa, Artificial Sequence
  Description of Artificial Sequence: Synthetic peptide
YYCSSFGGNDNLIFGQG

SEQ ID NO: 8494 - protein, 16 aa, Artificial Sequence
  Description of Artificial Sequence: Synthetic peptide
YYCQQEGSSPITFGQG

SEQ ID NO: 8495 - protein, 16 aa, Artificial Sequence
  Description of Artificial Sequence: Synthetic peptide
YYCQQYGSSPITFGQG

SEQ ID NO: 8496 - protein, 18 aa, Artificial Sequence
  Description of Artificial Sequence: Synthetic peptide
YYCQSYDFGLGIMVFGQG

SEQ ID NO: 8497 - protein, 19 aa, Artificial Sequence
  Description of Artificial Sequence: Synthetic peptide
YYCQSYDISNLSHVVFGQG

SEQ ID NO: 8498 - protein, 16 aa, Artificial Sequence
  Description of Artificial Sequence: Synthetic peptide
YYCSSYTSSSKVFGQG

SEQ ID NO: 8499 - protein, 18 aa, Artificial Sequence
  Description of Artificial Sequence: Synthetic peptide
YYCARGGASIGVFDVWGQ

SEQ ID NO: 8500 - protein, 15 aa, Artificial Sequence
  Description of Artificial Sequence: Synthetic peptide
YYCQTWGTGMVFGQG

SEQ ID NO: 8501 - protein, 15 aa, Artificial Sequence
  Description of Artificial Sequence: Synthetic peptide
YYCAPNSNSPSYWGQ

SEQ ID NO: 8502 - protein, 18 aa, Artificial Sequence
  Description of Artificial Sequence: Synthetic peptide
YYCHMWNASRNHWVFGQG

SEQ ID NO: 8503 - protein, 18 aa, Artificial Sequence
  Description of Artificial Sequence: Synthetic peptide
YYCHVWDSSGDHWVFGQG

SEQ ID NO: 8504 - protein, 16 aa, Artificial Sequence
  Description of Artificial Sequence: Synthetic peptide
YYCARNHHSDFDHWGQ

SEQ ID NO: 8505 - protein, 16 aa, Artificial Sequence
  Description of Artificial Sequence: Synthetic peptide
YYCQEYNAYPTTFGQG

SEQ ID NO: 8506 - protein, 16 aa, Artificial Sequence
  Description of Artificial Sequence: Synthetic peptide
YYCQQTVTPPFTFGQG

SEQ ID NO: 8507 - protein, 16 aa, Artificial Sequence
  Description of Artificial Sequence: Synthetic peptide
YYCQQYGSSPRTFGQG

SEQ ID NO: 8508 - protein, 16 aa, Artificial Sequence
  Description of Artificial Sequence: Synthetic peptide
YYCQQYYSTPRTFGQG

SEQ ID NO: 8509 - protein, 15 aa, Artificial Sequence
  Description of Artificial Sequence: Synthetic peptide
YYCARNWNDFDYWGQ

SEQ ID NO: 8510 - protein, 16 aa, Artificial Sequence
  Description of Artificial Sequence: Synthetic peptide
YYCQRYESSPRTFGQG

SEQ ID NO: 8511 - protein, 20 aa, Artificial Sequence
  Description of Artificial Sequence: Synthetic peptide
YYCVRHSGWLFPSAFDVWGQ

SEQ ID NO: 8512 - protein, 16 aa, Artificial Sequence
  Description of Artificial Sequence: Synthetic peptide
YYCQNWGTGVGGFGQG

SEQ ID NO: 8513 - protein, 19 aa, Artificial Sequence
  Description of Artificial Sequence: Synthetic peptide
YYCARGSVSTGIAFYYWGQ

SEQ ID NO: 8514 - protein, 17 aa, Artificial Sequence
  Description of Artificial Sequence: Synthetic peptide
YYCSSYTSSSSLVFGQG

SEQ ID NO: 8515 - protein, 26 aa, Artificial Sequence
  Description of Artificial Sequence: Synthetic peptide
YYCARGRYLASSSAHGGYYALDYWGQ

SEQ ID NO: 8516 - protein, 16 aa, Artificial Sequence
  Description of Artificial Sequence: Synthetic peptide
YYCQQAYSPPISFGQG

SEQ ID NO: 8517 - protein, 16 aa, Artificial Sequence
  Description of Artificial Sequence: Synthetic peptide
YYCQQAYSPPITFGQG

SEQ ID NO: 8518 - protein, 18 aa, Artificial Sequence
  Description of Artificial Sequence: Synthetic peptide
YYCARDFHRAYGMDYWGQ

SEQ ID NO: 8519 - protein, 18 aa, Artificial Sequence
  Description of Artificial Sequence: Synthetic peptide
YYCAREWLGTTGMDVWGQ

SEQ ID NO: 8520 - protein, 19 aa, Artificial Sequence
  Description of Artificial Sequence: Synthetic peptide
YYCGTWDSSSAPFYVFGQG

SEQ ID NO: 8521 - protein, 19 aa, Artificial Sequence
  Description of Artificial Sequence: Synthetic peptide
YYCGTWDSSSGPLKVFGQG

SEQ ID NO: 8522 - protein, 17 aa, Artificial Sequence
  Description of Artificial Sequence: Synthetic peptide
YYCARHDFSTGAYDWGQ

SEQ ID NO: 8523 - protein, 16 aa, Artificial Sequence
  Description of Artificial Sequence: Synthetic peptide
YYCMQGARWPLAFGQG

SEQ ID NO: 8524 - protein, 18 aa, Artificial Sequence
  Description of Artificial Sequence: Synthetic peptide
YYCARQKLRGDGFDTWGQ

SEQ ID NO: 8525 - protein, 15 aa, Artificial Sequence
  Description of Artificial Sequence: Synthetic peptide
YYCQHYGGPFTFGQG

SEQ ID NO: 8526 - protein, 21 aa, Artificial Sequence
  Description of Artificial Sequence: Synthetic peptide
YYCAADPLDEWDAYLFDVWGQ

SEQ ID NO: 8527 - protein, 16 aa, Artificial Sequence
  Description of Artificial Sequence: Synthetic peptide
YYCEAWESDTRIFGQG

SEQ ID NO: 8528 - protein, 15 aa, Artificial Sequence
  Description of Artificial Sequence: Synthetic peptide
YYCAKGRWDFDSWGQ

SEQ ID NO: 8529 - protein, 19 aa, Artificial Sequence
  Description of Artificial Sequence: Synthetic peptide
YYCQVWDSSSDKPYVFGQG

SEQ ID NO: 8530 - protein, 15 aa, Artificial Sequence
  Description of Artificial Sequence: Synthetic peptide
YYCARGDFLFRYWGQ

SEQ ID NO: 8531 - protein, 18 aa, Artificial Sequence
  Description of Artificial Sequence: Synthetic peptide
YYCQAWDSSTPFYVFGQG

SEQ ID NO: 8532 - protein, 18 aa, Artificial Sequence
  Description of Artificial Sequence: Synthetic peptide
YYCAKDEVWIAAFDYWGQ

SEQ ID NO: 8533 - protein, 20 aa, Artificial Sequence
  Description of Artificial Sequence: Synthetic peptide
YYCARDGSRDYGAGFDYWGQ

SEQ ID NO: 8534 - protein, 16 aa, Artificial Sequence
  Description of Artificial Sequence: Synthetic peptide
YYCQTWGNTHLVFGQG

SEQ ID NO: 8535 - protein, 18 aa, Artificial Sequence
  Description of Artificial Sequence: Synthetic peptide
YYCARDRTSRAALDYWGQ

SEQ ID NO: 8536 - protein, 16 aa, Artificial Sequence
  Description of Artificial Sequence: Synthetic peptide
YYCQTWGDTHLVFGQG

SEQ ID NO: 8537 - protein, 22 aa, Artificial Sequence
  Description of Artificial Sequence: Synthetic peptide
YYCARLYHTAYRYTYYFDVWGQ

SEQ ID NO: 8538 - protein, 16 aa, Artificial Sequence
  Description of Artificial Sequence: Synthetic peptide
YYCHVWDSSDVVFGQG

SEQ ID NO: 8539 - protein, 22 aa, Artificial Sequence
  Description of Artificial Sequence: Synthetic peptide
YYCAAHGGTNSRGWKALDYWGQ

SEQ ID NO: 8540 - protein, 18 aa, Artificial Sequence
  Description of Artificial Sequence: Synthetic peptide
YYCQAWDSTTPTVVFGQG

SEQ ID NO: 8541 - protein, 17 aa, Artificial Sequence
  Description of Artificial Sequence: Synthetic peptide
YYCARNRGTGDLDYWGQ

SEQ ID NO: 8542 - protein, 19 aa, Artificial Sequence
  Description of Artificial Sequence: Synthetic peptide
YYCQVWDNGSDHLVVFGQG

SEQ ID NO: 8543 - protein, 19 aa, Artificial Sequence
  Description of Artificial Sequence: Synthetic peptide
YYCQVWDSSSDHLVVFGQG

SEQ ID NO: 8544 - protein, 17 aa, Artificial Sequence
  Description of Artificial Sequence: Synthetic peptide
YYCARNSGQGDLNPWGQ

SEQ ID NO: 8545 - protein, 21 aa, Artificial Sequence
  Description of Artificial Sequence: Synthetic peptide
YYCGTWDSSLLSSSLVVFGQG

SEQ ID NO: 8546 - protein, 19 aa, Artificial Sequence
  Description of Artificial Sequence: Synthetic peptide
YYCQAWDTSTSSHVVFGQG

SEQ ID NO: 8547 - protein, 19 aa, Artificial Sequence
  Description of Artificial Sequence: Synthetic peptide
YYCQVWDSSASPHVVFGQG

SEQ ID NO: 8548 - protein, 19 aa, Artificial Sequence
  Description of Artificial Sequence: Synthetic peptide
YYCQVWDSSSDGLVVFGQG

SEQ ID NO: 8549 - protein, 17 aa, Artificial Sequence
  Description of Artificial Sequence: Synthetic peptide
YYCARNSGQGELKPWGQ

SEQ ID NO: 8550 - protein, 19 aa, Artificial Sequence
  Description of Artificial Sequence: Synthetic peptide
YYCQVWDTSGNHPVVFGQG

SEQ ID NO: 8551 - protein, 17 aa, Artificial Sequence
  Description of Artificial Sequence: Synthetic peptide
YYCARNSGQGELNPWGQ

SEQ ID NO: 8552 - protein, 19 aa, Artificial Sequence
  Description of Artificial Sequence: Synthetic peptide
YYCQVWDASSDPFVVFGQG

SEQ ID NO: 8553 - protein, 19 aa, Artificial Sequence
  Description of Artificial Sequence: Synthetic peptide
YYCQVWDSSSDHHVVFGQG

SEQ ID NO: 8554 - protein, 18 aa, Artificial Sequence
  Description of Artificial Sequence: Synthetic peptide
YYCQVWDSSSPVVVFGQG

SEQ ID NO: 8555 - protein, 17 aa, Artificial Sequence
  Description of Artificial Sequence: Synthetic peptide
YYCARDPRGDAFDIWGQ

SEQ ID NO: 8556 - protein, 16 aa, Artificial Sequence
  Description of Artificial Sequence: Synthetic peptide
YYCQQYHTTPPTFGQG

SEQ ID NO: 8557 - protein, 19 aa, Artificial Sequence
  Description of Artificial Sequence: Synthetic peptide
YYCARGDSSGWDYFDHWGQ

SEQ ID NO: 8558 - protein, 17 aa, Artificial Sequence
  Description of Artificial Sequence: Synthetic peptide
YYCQQSNSPPPITFGQG

SEQ ID NO: 8559 - protein, 19 aa, Artificial Sequence
  Description of Artificial Sequence: Synthetic peptide
YYCARLSGTYYYAMDVWGQ

SEQ ID NO: 8560 - protein, 16 aa, Artificial Sequence
  Description of Artificial Sequence: Synthetic peptide
YYCQQSDRLPLTFGQG

SEQ ID NO: 8561 - protein, 27 aa, Artificial Sequence
  Description of Artificial Sequence: Synthetic peptide
YYCARLGYKGFAYLGSYSSYAFDLWGQ

SEQ ID NO: 8562 - protein, 16 aa, Artificial Sequence
  Description of Artificial Sequence: Synthetic peptide
YYCQQSNSPPITFGQG

We claim:

1. A library comprising a plurality of nucleic acids, wherein the plurality together encodes a set of polypeptide binder moieties characterized in that:
   a) each polypeptide binder moiety has a length within a range of 10 to 400 amino acids; and
   b) each polypeptide binder has been determined to bind specifically to a particular group of peptide barcodes within a collection of barcodes, and
   wherein each nucleic acid comprises, in order from 5' to 3' or 3' to 5':
      i) a first invariant sequence;
      ii) a first variant sequence that is at least 10 nucleotides long; and
      iii) a second invariant sequence,
   wherein the set of polypeptide binder moieties comprises at least one polypeptide binder moiety having an amino acid sequence selected from the group consisting of SEQ ID NOs: 4200-5346, and
   wherein the plurality of nucleic acids comprises at least one nucleic acid having an encoding sequence selected from the group consisting of SEQ ID NOs: 1-1147.

2. A library of phage particles, each phage particle comprising one or more nucleic acids,
   wherein each nucleic acid comprises a sequence encoding a polypeptide binder moiety characterized in that:
   a) the polypeptide binder moiety has a length within a range of 10 to 400 amino acids; and
   b) the polypeptide binder moiety has been determined to bind specifically to a particular group of peptide barcodes within a collection of barcodes, and
   wherein each nucleic acid comprises, in order from 5' to 3' or 3' to 5':
      i) a first invariant sequence;
      ii) a first variant sequence that is at least 10 nucleotides long; and
      iii) a second invariant sequence, wherein the polypeptide binder moiety has an amino acid sequence selected from the group consisting of SEQ ID NOs: 4200-5346, and wherein the one or more nucleic acids comprises at least one nucleic acid having an encoding sequence selected from the group consisting of SEQ ID NOs: 1-1147.

3. The library of claim 1, wherein each nucleic acid further comprises one or more of:
d) a stop codon;
e) a linker sequence;
f) a third invariant sequence;
g) a second variant sequence that is at least 10 nucleotides long; and
h) a fourth invariant sequence.

4. The library of claim 2, wherein the phage particle is selected from the group consisting of M13, T4, T7, Lambda, and filamentous phage.

5. The library of claim 2, wherein the phage particle is M13.

6. The library of claim 1, wherein the first invariant sequence or second invariant sequence comprises an antibody germline sequence.

7. The library of claim 6, wherein the antibody germline sequence comprises an amino acid sequence according to IGHV, IGKV, IDHJ, or IGKJ.

8. The library of claim 1, wherein the first variant sequence comprises a CDR sequence.

9. The library of claim 8, wherein the CDR sequence is a CDR3 sequence.

10. The library of claim 3, wherein the stop codon is positioned after the second invariant sequence.

11. The library of claim 3, wherein the third invariant sequence or fourth invariant sequence comprises an antibody germline sequence.

12. The library of claim 11, wherein the antibody germline sequence comprises an amino acid sequence according to IGHV, IGKV, IDHJ, or IGKJ.

13. The library of claim 3, wherein the second variant sequence comprises a CDR sequence.

14. The library of claim 13, wherein the CDR sequence is a CDR3 sequence.

15. The library of claim 2, wherein the one or more nucleic acids encodes at least one polypeptide binder moiety.

\* \* \* \* \*